United States Patent 9,677,139 (GENETIC MARKERS INDICATIVE OF A CANCER PATIENT RESPONSE TO TRASTUZUMAB (HERCEPTIN)) - sequence listing, part 5

SEQ ID NO: 1 - DNA, 15429001 bp, Homo sapiens (residues 8,816,573-11,020,715 of 15,429,001)
atgtcaatggagtgttcattttacttattatgaatactactttcttccactataatcattaaaatcagataaaacatttattcaatttgtttcatgtatttttatttaattactgttattgtacagttatatgtatttaagaatttagtatattttctacttgttttatgactgaatattttaaaaaatttgttataaattttcagtacttccttcgtataatacatagcatacatattagcttacttcagcaccacctaaattaatgtttctgtaagaaacattacaaagtccaaataatacattgtttagaattctaagtctgtttataatttagggactgcttataatgattcatttggggggtttaatccatagcatcaggcatatatgaaatgtgcattaatggcacaggaagaaaaggagacaaaggaagcatctacttttaattacctctgaaaaatatctaagtaatttcatacacatgtctacctgttttcttcctgaccatctcaagggacagctttgccacaatagttcccagtaactggttttattccaaacaaatgtagcccaagctgtacttaaatctgcattatatctgggtgtctccttcttgctctcctttctcccttctatgaggactttgccttttgttaatcagctaacaaaattcacgtagtgccactcatcaagaaatcaaggccctgtaatagggtgctaggttattcttattgaaatgtagtatccatctcgctcaatatgaagcctatgattgaatttaaataataaccaaatctacagctcaaccaattggtttttaatgagattcttgcatagttatattttattttgtataaggaatagggtccttgtgcatcattgactatggaaaggttaaggaagaaaaaagtgtaaagagagttttaaaacatataaggttaattgaaattccaggttcttctgcaatcaaagcaattctaactcagtttggtggcaatgaaacatgttttagaggtgtgttagttacggttatgaggagcagatattttaccctggttagtgttaattttgctaaagaaaccagtgtctcagaaaaagttttatttccatttggatgtggttttgttagtgtaaatttgataggaagggcaagactctccaaagttgggtcttcttcctttccttttcaaaagagagatggtcaaaggcaggagctaaagcatcttgatttgaaaaatagacctttaattaaagaacgccattttcttgtcctgctagaaaacaaaaccacatctttaaatcttctgtggatggttgagagattataataaagattggtgtgctaataatcctttttatatatatataaaagcaaaactgatggattttagtaactataaaatactattgaatatatcaatcgcatacatttttattggctgcattttctagtaattgcatataacacatgaatgtgcttctaattaaattaattcatttagagaaaaaaagaccttataaagcaattgctagtttcatgatcttttttttttttttttttgatatggagtctggctgtcacccaggctggagggtagtggtgcactgcaacctctgcctccctggttcaggtgagtctcctgcctcagcctcccaagtagctaggactacaaacatgcaccaccacgcctaatttttttattttcagtaaagatggggtttcaccgtgttggccaggcttgtctcaaactcctggcctcaattaatcctcccacctggacctcccaaagtgctggcattacagacatgagccaccatgcctggcctaatcttatttaccatagattttttttttttaggtgaatgaactaggaaactattgtcattgtttgaaaaataacactatgcgttgataactgcaaaaagtggcaattaagtagtttatgttattcctaatgctaatagtaaataatgacactgaaacaggaaaggttcccttgtctccctcgcagggcgtgcgatgggggtgtggctcacttcttcagtgccccactgctctaggggagcatacagacatgcaggctgtggggctccgagcctacagcagtgtctaggagtgaatgtttacagctgaagccccagtgggtgtgtgttacatgatgctcttttagtttgctgtttataggcagcttgtattaaccagctcagtaagaccctctaccttgtccctagggcagagggttttccgtatcctgggttgttgccttggtgtaccggaagaatcggaccacacgtgggcttggagaatgagtgcaaagttttttttgtttgtttgtttgtttttttttttgagacggagtctcgctctgtcgcccaggctggagtgcagtggctccatctgggctcactgcaagctccgcctcctgggttcacgcggttctcctgcctcagcctctcaagtagctgggactacaggcacctgctaccatgcccagctaatttttttgtgtttttagtagagacggggttttaccttgttagccaggatggtctccatctcctgacctcgtgatccgaccgcctcggcctcccaaagtgctgggattacaggcgtgagccaccgcgcccggccgagtgcaaagttttattgactagaagtagctctcagcggatggggaagccagaagggagctgcagtttggctcctcactggccccggctctcctttgactgcctccgccaaactctgcctcgtcccgccggttgatggcctgctggcgtggcagcgcctattggcgtgctctcccgctggcgtgctctcgacagccttgtcgagaaatagcttgtgtcttcttccaccgatgtgttcttcacgatgtccagcagcttctttttctgctgatgtgctcctcttgacatcaggccgcctgcgtgtctacctgctagggtataagcccaggatgggggcatggtgggccagagtggtcttggaaaatgcaacatttggatacgaaagcaggagtgcctgtcctcacccaggtccatagggttggagccctagctagggacttgcttttctttaccgggcacttccctgaccccgtatcaacattacttgattaaaatttcaactttgctacttatttgcaaccttatttgtaaccttgggcaagctaattgacttttcttcctcttcagtaaaatgtctctgtgtacatgtgtgtaagtttgcaatgtaaataatagtttttggccgggcgcggtggctcacgcctgtaatcccagcactctgggaggcagagacgggcggatcacgaggtcaggagatcgagaccatcctggctaacacggtgaaaccccgtctctactaaaaatacaaaaaaaaaaaaaaattatttgggcgtagtggcgggcacctgtagtcccagctactgggcaggctgaggcaggagaatggcgtgaacccggaaggtggagcttgcagtgagccgagatcgtgccactgcactccagcttgggtgacagagcgacactccgtctcaaaaaaaaaaaaatagtttttttctgaggatcaattcatttaattcatataaagcacttagaacataatacatgcaatatatgttttcatttttctattcaacaaaagttatactttgagctaattccccttccctagcagacacatcatctcagccaatgtaaaggcttctctttccttcattctaggattgtctatattgcaggagcttacagagtaacaggctttagtgggggtgctagggcaacagatccgaccctcagagtccttgctcatacagttgtctgctgacatgagccgtccatcatactgactggccttcacaatctaggtcatttctaatatatgtttgatatgtcgatttttcatctgtccctgggcacacagagaaactgtgaggctgtttgaagtcctgtctgcctagacagtcggaggcatagctcctgctccagccatgctgctggccttgtgttctccccatggaatgaaactcagggctcccctcattttctggtcctacaaatctaactggaagtttgcatatgtaaataggatggactctggaacaaatttgcccaaaaaatgtagaagcacagaaacataagtatctattagagttaccaaattaatattattttgagcaaactctttcattccattttttggaaggaaaaggaagattaaagacagtaattgggatgtgcaaagacattagcaataatcctgggctgttatttaccctgagcttgggccaggggactccttgacatttgatcagctgacatcatgactattaaactaaagaaacatttgtgagagtgtaactgcacaagaccaatctggttcaacttttatgtaataaagttccgagttgattttaagttgccatgaaggtcacgaaacctgagcatgcccagttgaaccaagggtgtaaccacaggtggaacttgagtgctcccaccaaggagtggagaatgagttaggaagccgacaccacatggcaagatccaggatccaatcagattgagttttggcttcatcccatagcaagatccagtcagatcatgccttccagcatcacctagttgcaagatccaatcagagcacacctcattaccttatgcttataaaacccaacccagtccccagctcagagaaatagatttgagcttttcctcagtctccttgagggccaacagctggtcttttctcaaaagccagtacggtggtgttggcctctatgcacacagggcagtgagcccactgagtgcttggtaatgagaggtcaaggactctggtgtttagtgccataccgtgaatgtagtatatgaatgatttggtcatagtgaaaacaatatttggggagtgttaggagagagattggtcacttctggctagttatgcagggaaagggaagaaaatggaagaggaggtatataatttaggcctggaaggttggctggggtttaagcaaagacaaattttgcaaagaaaaacacttaatgccgtttctactcaaagtttatcttttttcatcctcaaatttaataaataggacagtgttttgtcgtggaaagcctgtagactttgcagtcattagactctactgccagtgagttgttggatgactttagaaaatcagtctctgtgcctctgtaaaatgacaatgacatctgcctaacagggctgagaaaatcaaattctgaaccacacataaagtagctaaagtaccctgcctaatgccttgtagcaactcaataattgctatttcccttcctttctcccttttgatcccagtggctttaatgttaagtttatgtagcttatgttggggaccttaacaaaatttccttaagtatctaattctagaaataagcagtttggattgatagtccacttttttcttggaagaatctgtaaaacataagatgtttattggctctgatgcctaacccaaatttgtataatcataaaatgtaaccaaatagctggtgatacatagagcctaaaaagagatgtttgatttacaggattttttaaatcagaaaattctacaaagagctattttcaaaggagcacttctgcagacctgacatctaagactttgcaagtggttgcatttagtgggaaacatgatgtttttctcccaattgacctcttaagaattaggtcacagggtacactctgttcccaccaattaggctttgataacatctaattggacaattaagctccctctttagaccttttgctcttattatgtacaaatttaccccatctcaagaagcatgagacagctcccctggagtaaaaatgaaagacattacagttttgaggtgtgtgggagtgaaacagagaactattctctgctatataggctaaccatggagttgtagaagtcgcaaatgctaatccatttttcacatcgacatggggcagaatttccagtcttggtactgttgggtgtccggagatggtttggagagaggaaaattagaagagaaaagctgctgtcaatggagaggaagtcaaaactcgtctacataaagacagtctgattttgacttttgctaggcaaagccctttataattattttatccagtcatacaagtgaaataagcatgaaatcacaaaatggcattttgatgccatttatgataaatgaaaatcgtctttgattagctctaaataagaatatttctaatagagcaaagaattgtatctgaataaattgctcattaatgatgtctgcacagcacaattgagagtctgcagtattaggtactaactcagaaagaaaattgtgtttggactgatttttaacttgttatcctaaataattcaaatccatttctcctcagcacgatttcttgcagcagtgttaagcattcagcttattttgtgctgttttgacctggcatttgtaatagtttgggggtgaggatgggtacaccatatttgtttttcagttatcccatttatgaccactgttggggggctcagttaatttttatgtgaatatttttcaagtggtttgcattttttgttgcctgcattactttgttgttgttgttgttgttgttgttgttgttgttgttttgagacagatcctcgctcttgttgcccaggctggagtacaatagtgccatctcggctcactgcaacctctgcctcctgggttcaagcgattctcctgcctcaacctcttgaatagctgggattaaaggtgcccaccaccacgcctggctaatttttgtatttttagtagagatgaggtttcaccatgttggccaggctggtctcgaactcctgacctcaggtgatccgcccacctaggcctcccagagtgctgggattataggcgtgagctactgcgcctgacctgcattagttactttgatcctgttctcacattcattccttgcttgagagcagtagattcaaggagttatttcctcaatgtcgtgtatttactttgctatcccattctgtcatctttgtcatctgctttgacatggaactgttctgcattacttctcttcttcctgctttacttattgagattgtgtcctgcttctaattaacagatagacttgagaattctttggtggttctaatttgtgatactacatttacagttagtcagagttaatattaaatacatattttcacaactttttgctttattagaaatatttcattaaagttaaccttcagatttaagcataaaatgatacttcatacaattttattgatggtttctctgaactctcttaataatgtatacatttcttatagaaccatgtagcctattatttatattctttctcccctactagttacagatacaaaatctgatggctctcatgttccaacaaactatggctcatgggccatctagccaaccatctgtttttataaagttcatgagttgagtgatttttacacttctcaatgtcaaaaggatttcatccttatgacagaggctgtataaagcctaacatatttactgtccatccccttacagaaaagtttacagatctgcactataaagttgagatctgcaacttttagaaatttatagaagtatttctaacactctaaagtattagaacagtgcttttcataagaaatgttccctaaaggatttcaaattgtcaaataaatgtatattacattggaagtcattatttaagccatttataccaatgaatccatagagacaatatagaactaggaattttcattggaatttgaagtcaaactagcatcaggtactctgctgtttctctgttgtcattcttctggaatcaaggttagtagctatagggcatagtcatataaagatgatccagcctgtgggattctggaaaagattgagaaggtgcataaatttgaagaacactaagaacttcctgcttgaaaatgaaaggaagacttttaaaactaattgataaaattcaaacaccaattttaagtaaactaataaaaaaccccagggatttcatttagataaaataactcttaggataagaaaaataaacaatcttgatttaaaacaaagcagacatcatataaaactcgcatccctacctgtggattagaaaaagtatatagagaataataacttgatacacgtataaaagatgaagaaagctttaaaatcacactaagaggagtatgagatgaattttctctcttattttgacaacctctgacactaaaaaagaaatggcaaaaattgaaaaagaaatatatttcttatgctcgtctccttatccacattttgttatgatgaggcagcactgaaaatgttagtgattacaaaaggtgagttaccagaaagatgagattttcttttttgtttgtttgttttttgagacagggtctcgctctatcacccaagctggagtgcagtggtgcaatcttggctcactgcaacctccgcctcccaggttcaagcgattctcgtgcctcagcctcctgagtagctgggattacaggtgtccaccaccgtgcctggctaatttttgtatttttagtagagacagggtttcaccatattggccaggctgatctcgaactcttgacctcaggtgatccacccgtctaggcctcccaaagtgctgggattacaggcttgcgccaccatgccggccagattttctttccttttatttttatatgttgaccagggatttctgatattcatagttttaacagcaccttggatgtttaacagtggttttgaatacaaaatatcattttctgtacttaaattcataaaagaaaagttgtagttaaaatgtttcccaaaagttcataaattttaatacgtgacatttaataggcaatatataactaaaacttagacttgctcttacttgccaggacaatgttttacttagtacgtttgcattaagcacctattggcgatgagactatcatccctcttcttcttactatcatgcctactataattagcttgaaaatattcaaataagtatcatataaacacatgccataagtgtagccccaaatgcataaaagcccagagtaggggagaattttatttgtctgggggtaatcattgaagagttagcagtggctcttgaaagatttataatgggtaaagattggggatgagtaatccaagcaggactggcaggagaaagcccatgaaagcaggaaccatatgagatgtcttcagaaagtgatatatcacttactatgtatcatttggggtatatgtaggagaataagtccccaagttaaaataaaaccattacagaaagatggcatgaaatcatgtttagatggtatgttttcttatttaaaatctaggcagattcaactggcagtgaatataaaacactgaaataaaatttgatattctgatatggaaaaaaaaaacgacattaagcatcagtacttgaaaaactagtgatctgaatgctctgtgaagacctgcccggtaaaatttactagggagaagaaagttgtattagccaggatgtcacatcatgcttcatcatccttagcttctctctgccaaagcaaaaggagagaagcagggagttcaggacttcatctgggccatttagaagaaaaaaatcctttctagaaatagcatagcatttgttataggcctgtataggtttatcacttgtgcaatttggtcattgcttacaagtcctgtttgctctgcctaggttggtaaagccataggtttctggttacaaaaacatgtaactaatgcatttccacatttttattttgaggatttctgagaaggaagcccccaaagcaaaaactctggagcaaagatgtgtggatattaacattatactcattatccatcattatcagtttcatctttattataaaataatctttttgtacacagaactctccaaggcccaggctgcaatgtccatgacagtttataactccatgaaatgtaattccttgtgctctgatatgacgagactataaaggtttagtgataatgaaggaaaaagatgaaagaaaacattacttatgtagcatagtttagggaatgaaatgcttaatcaaatttagaaaagtaaagctgtattgctaacaaaaaatacctatctgtttacctttttatgggaaaagtacaaattttctgaatagttgggtcaaatcccaaaataccgtgtgactctataatacagaatgaaaagcatctattgtattcaaaccacgtgttcaggctaaaaggtaatgttaactggatttactgaatccagcctaggaactttgatatccttctgtgccctgtgaggacttagaagcctctgcacaatattaagctgcctatggaggatcatactgtcttttatcaatctgggttgccccttatccagttttgctcctattaacttctgctgcaaccccttctggtaaaggaatagaagttagatattcttttcttgccatcatttttgcattgatgtggctctgtctgtgcctgaagatttcaggaataaatagatattatggatcaagaaaagaataagaataaaattgtgaagttgacctagctattagagaatatttttcactattagcttggaagaagatctgcttcaatagcgtatgatatcggaaccctgactttggaggcttcagacatcctgaaatataattcagataatatgaaaaggatgcacgctgaagcctctaaagctctgttcctgcagattttcatctcttcctgttacgaaactaaaatgatagccattctcttatctgtgcacaaggtataaacaagttaattgatggctgttcttcctgagttacattcagtctactggggaaaacctatgtgtaatgagtttagaaatagagtgaattagaatgtaatgtcacaaataagcagtgaaactttaattcatacttttatgatagccaacttagattactgtaattctctgtctccttcaggtgtcccactggaaaaagaaaagatagcttgtacaagtatgcaacccctgagattttaagcacgcagaatctggtcaacatacacctagacttagagattttggttctagctgccagtgagctactagattgattgtaagaggtcctagtgatgtgtttttgaaacactgcatgaatccaaatgagttttaggttccctattgtccaagccgaattttgttcaactgtaaaaacgttgggtttttatttgttcagaactactattataaatcacaatgccctatagttttttcaagcacttgtggaatatatttttcccagacagattcagaatatcagaagtgtcattgaatttaggtcaagactaaagtgacttgtttaatttgttttctttcaatagtactgattctttctgtgtagctttcctaggtactttaagaaatcctttaaaatcttagcattgtaatatttaagaataccatttaaaatggacacagttgatagaatctggattaaaagcatattaatttatatgcatactctgctatgcatggtaacatcatagccatcactctcatgggtttcttgttggtgaaagaaacattttgtattttgcttataatgttaattatattgtataggatattttatagaaatattttgagatcatttttcacaggtgttattttcattataaattctcatattattatattggtgtcaatcatacttgaaattaaatcattgaaatgcatttgcactgtttaaaaaaatctggtagttgaaataacaataaaggcctttatttctaagtgcagttgcataatttagtttatttctctactggcattttcctatttcttttaagcatatttcttccactatatagacacttatttgctataaatattgtagtcagtgaaattgttctcaccctttacctgttggtcatatttggtatgtgacagcagttttatgcatattaagtcagcaatacttgttttaagggaaagatatattactgattactaactacgtcagttttatttcttctgagcatgggataattgttagctgtataattataggcaatgtggcataagaaataaaaatgagatttgaaaatgaaaaatattgtggttatggacaagtcactttgcttttcaaaaaattatttattattctttataactgacataagattgtatttgctgtgtacaacacatgggtttctgggttttgtttttagctttttgtagcgatggggtcttgctgtgttgcctcggctggccttaaactcctggccttaggcaaccctcccaccttggccccccacattctgggtttataggcatgagccaccacgctcagcccaacatatggttttaaagtatgtatacactgtggaatgactagctaattaacatatggattacctcacatagttttatttctgtggtgagaacacttgacattcactctcttggcattttccaagaatatattattaactttagtcagcatactctacagtagagctcttgaacttattctccctatcttactgaaattttgtatcttgactaacctctccacattcccccctacccccaacaacctcaggccctgataaccacccttctaatctctacttctatgagatcaaactttttagcttccacatatgagtaagatcatctggtatttgtctttctgtgcctgccttatttcacttaacgtagtgttctccaggctcatccgcgttgttgttttgagcttcttttgttatttgtcagatagatagtagtagttcatgacttatgttgagaattaaaataaatataaaagcactttgtaagctataagagtctttgaggctggtggctcaggcctgtaatcccagtgctttgggaggctgaggcaggtggattgcttgagcccaggagttccagatcagcctatgcaacatagaaaaactggtctttgcaaaaaatacaaaaattagccgggtgtggtggtgcttgcctgtagtcccagctacttgggaggctgaggcgggaggatcacttgagcctaagaggccagagtttgcagtgagccgagattgccccactgcaccacagcttgggtgatagagcaagactcagtctcaaaaaaataaaaaagactatttgataatattagttatttatagcactggtctagtggaagcaaagattttattgataagaaacaaagtatgtagcagcttactttagtacagtcatgcactgcataaggacctttcacttaacaaaggatcacatgtatgatggtgatcccataagattataatggctctaaaaattcctatctattagtatttactataccatactatttactgttattttagagtactcatacatatatatgcatatatatacacatatatatttttgtatatatacacatattttttgtatatatacacatacatatgtatttatatatatatatatatacatatatatatacacacacacacacacacatatatatataaattaactgtgaaacagcctcggggaggttctttgggaggtattccagaagaaggctttattatcataggataattttatcctataatcataggataaaattttatccatattatcacactccaaatggactattgcttctgaagaccttccagtaggacaagatgtggaggtggaggacagtgatattgatgctcctgaccctgtgtaggcctaagctaatgtgtgtgcttatgtgtgttcgtgtctttatttttaacaaaaaagctcaaaaagtgaaaaaaatattttcaaataggaaaagcttatagaataaggatataaaggaagaaaatttttttgttcaactgtacactgtatttgtgttttaagctgtgctattacaaaagtcaaaaagtttaaaatattaaaaagtttataaagtaaaagttacagtaatctaagtaatttattattgaagaaagaaaaaatacttttaaaataaatgtactgtagcctaagtatacaatgttcataaactctgtagtagtgtacagtgatgccctaggccttcacattcactcaccactcactgattcacccagctccacttccagttctgcaagcttcattcaagttaggcacctatacaggtgtacctgtgtttttactgtattttaccttttatactcctttaatttttactttatcttttctaagtttagaaacacaaaaacttaaccactgtgttacagttgtttatagtatgtagtacagttacacacacactgtacaggtttgtaacttaggggcaacagattaccccatatagtctaggtgtgcagtaggtgtgtcagtacactctatggtgtttgtgcaatgacaacattgtcttatgatacatttctcagaatatatcctcattaagcgacacatgattatattttattttgaggcagagtttgttctaacagctgatccttctccccactctttttttttgctacatattctcttgcacttttttgatttattattccacttgtatgtctattagtatgttttatacaaatatcagtataaaacaatgcacatgatgacctctttatggtatcttagtaacaatccagataataaaatctttgagtatgtgcaaaaatatggtagtaaatatggaaagtgaaaatatacattattgagatcgttttgagacatttcattctgtaagttcacagtagcagaaataaccaccatttttccaaactgtcacaaaatatagtggtaattatgctgggatgaatacacatctcatttccatattttctatagggtttctttaatgttattaatatgatattaagcaggggattcttcgtttcaggtgacttgagagctatttctgaccatatctttgagcttttcctagtaaggaaaggtgaagttcaaatgcctgagcatacagatgtggtaccatgtggaaagggtggggtgactcaatcttatttccctcttggtttcttcctgttattgctctgttttgagtaattgcccctttcttctgagaaaacaaaaaaagcagcctttcttagggaatcacaaatgagctcctttaattctgtggaccaagtccttttgcagaccagttaaagtggttaatctcttgctactgatccagctgtaggacatctttttccttgaactgttgaaagctcacaggctacttggattctttcttctttgtgttttctgcctgaactttttactactgaattttttcctctttcttttgttttacatcattgccaaactcatgtgtattattttttttaaaaaggagcatttatagatgggaagaattgtcccagttttatgcatgtccggtgcaattcatgctctacttgaaagtgattctgcattttgtctgtaaaacaaactcagaaggcttcatccagaaccagtttacacagcttcaaagaagaatgcagatgtgacatagtacgaatgctaacagcgatggtaaggtctcacaacacctaggtgagcttctgatgttcccagattacttccagtcaccataaattactttgccatccactagctcttaaaactttcctttttattgcacaaaatgcaagtgaaaaaacagaagctggaaaatgcatacatgtaaatgtacagctggactttctcctgtaggctaggttgcaataattatagattaggcctttagaatatttcatttcacaaagaatgaattcttctttacatgccctaagtcttgttctatcctctaaatcaattattttcaacagacatttcctgaacatgctaggtagtaagctgaacgcacacatatgaataaaatatagtcttaatcacttatggtctcccttggcttgaggaactcataagctaactgcttagaagttgtaaagaatttattttgggggaagagcctaactaataacaatgaagatacttaaaacttattgacttgtaaagacaggatagcatagtagttaaaagcttggactctgatttcaccactttctagtgttgaccattggaaaagtggtttgatcatctgatgcctgtttcttcatttaccaaaaatagttagtaacagaatttacctcataggcttgttgcagggcttaaatgagttaatagttgtaaggcacttagaacagtgcctggagtcaaataattgtttaaaaatagttaaaatgctttgcttataccaaggatagatctaacattaggaatgcacagatggtattagtcatctattgtgtaacaaattacccccaaacctagcagcttaaaacaacaaacctattgtcaggcatgtgaatacctagttagctatttgtctctgattcagggtcacttaaggcagcaactaagctgtgagctggggctgcaatcatcttaggtcttgaatagggaaggatcagcttcgaaggtcattgttgtgatgattggcaggtctcaggtgtttgtaggttgtcagatggagacatcagttccatgtcacatggacctcatgggacattttataacatggcaactggcttccctcagactgcggaatggaggaagtaagaaagggcaccacagaggaagccactgttttatgatgaaatgatattctatcacttttactgcattttgtttgttataagcaagtcactgggtctgggccacactcaagggaaaggatttacacaagggtctgaataccagaaggtggatttctttggtgaccatcttatgagataccaaccacagagatgattagtatttttcttagcctataaatgctaaatagaatgtatttaagtacacagtgtttagaaactgtatttatagttcttccagtaagagagaaatgaaagtcacttaaaatctccagaaatttggcaatctttgaatgaactttatttgctcaacttaaagtttgtctcagatgccaggttgttcattaaagtttctgttagtccattgtctgtctttaaaagatagaaagaccatggtaacttgaaagtcgccaagtagaactcccccagggttggaactaatactgcttctttcctctgaagctcttgttccactctgatttgtggatttacttatataatttagtcaagactatggcttcttggaagaaatctcagaaggactgaaatataatagcttctttgtccatacagcccccaaagtgtgattcacagaatattttgcccttcatggctcatgagaaaccacgtcatgtctttaagtcattgacttaaaactaaattatgaggatgaatcacaaaatgatgtaaagaaaagtgtctgttgaatttagtatgaataatcaacctgtataatgtaagataaaaagagaaaaatagtgttctaagataagagttgctatgattttatttggtcttgaagcactgagatgtattctattttgcctcatcagttcaatcaaacacacataattaatattttgttactaattaatttgtgtgtactttgaaaaagtatccttgaactacacaatttatatgaactatttctgaagtatatttagaagagaaaaaaaatttatgattgctttttcaattagtattcctctgcttatattgtgcctgacctcttttaaaaccttaatttaaatgaagagtaaagaattcaacattctcttgcaaggtgtattccggatgaaatattcttcagttatgtttcaaaaacatacagagttgttctgaattttaattagactggcaatgaactcttgttctctagaaacatgaatagtaagacacaatttcctagcagcatcgtaacgacaaaaacaacaacaacaaaatgatgtttcagtatgcctttcgatgaggagagaaagtagagaaacttactattaagagatatattggttacattaatttaaaaatttatacagtaagtgaattttgtggaaaaaataattgtttctattttctgattagaccacctgcataacctcatcttctcatcctaattcttctctattatttctgaacccttccgtattaattatcctccctttctattccatcttccatgtcttcctccccatggacctctttttctctgcctattcacaggcccagacctcttatttataaacagaaaataaaatagaaattttcctttagccatgccattcccttgaggaactgacttatcatgcacatttttaaccaaaccaaaccaaacaaaacaaaacaaaaactctttgacagaaactgtttctgtcctctatgctttttatctttgcattcttcaaccctaaataatctaccttccaccttaactccttagcaagtgagcagcagccgtcacatgtgattgtatcataacacaaacaatggtctcttttcaattttcatctaccttgataagttgtcaatgactaacactgattcccccaaccctttttgcagaaatcaatcaccctggctttcttgatatagcattttatagttctcctatctcccactaaaggaagaaatagaaagacagagagagagagagaatggtgagacatacttaattaatataaataattggtttacactattatagaggtggagaagtctgaagatcttcaactggcaagctagaaaaccaaaagagctgatggtgtagtaccagtccaagtcaaaaggcctgagaaacagaacagtggtctaagttccagtccaaaggtagcaggcttgagacccaaaatgaaccatttcagtctgagcccaaaggctggaaaaaccaactttccagtgcaagcagtccgacagaagtaattccctcttactcaagggagggtcaaattttgtcttgttcaagttttcagctgattagttgagggccatccacattatggaaagtaatctgctttactcagtttaataattcaaatattaatcttatccaaaaacaccctcacagacacactcagaataatgtttaaccaagtagctgggcaccccatggcccagtcaagttgacatataaaattaaccacacaccaccacccattctaaattcccttttccctcaaatgacacatagcaaatcagggtttattccttgtgggtaactcaaatcttccttgttgtagcagaattgggaagtaaccttgcccagagcattgcatcttccagaatattctttcagtcttcacaatatagcaatgactatttccccgtaagatgtattaatcacccactaaaacagtaacaccccttgttcctttgtcggttcagtaacatgtggactcccaaatgaccaggcgacaatgccatctgctagtgcagtgggatcatttttatttttttggttgagaacattactcccttggatactgtttcagttacagaacaagataacctgctaccatgaagaaaccacaaaatacggtagctcaaacaagatactcttttcccctcccatgagtccagtactggcagatggtttagggcataaaactatctctgctttataagattacataggggcttcttcagtcttgttctgtcttgttgctctgtagtgctgtagggttttgcaggcatggtcagaactggatcatctgcattacatctgtagaatttgtatgtatttctacatatgaatgtggaaagaaagtagagttcaggcattttccattattaaagatttgacctgaaagttgcatgcatcactctgctcacaccccattagtcataacttaaccacatgactacctaataggtgcaatggaaaattgtaacatgtagtctctaaccgggcagccatgtgctaaatacttagggtgctctataattaagatgtagaaagggatcattagtcttggggacattattagtattgaaacctctaaacaactggagaccaaagttccaggatggaaaacaaaattatgaacaagacagcaggtttgagagcaaggtgccactttcattccttggtcccaggctcatgtatttttggttttgagagacttggcatcatatacgagatgatggtttgaagcatataccacatcctgaaagacagtgccccaaccacggtgggattggtgctcactgggaggattaatctttcctactgtccatcagggacaccctgactgtcctgaaatgctatattggtctacctctgcatggttataacataccatgtttatgtaaaccaagtccaaatgttttcttcctcagtcgagtagtaacaaaagtcattctcatgagactttatgagggagaggaggcaggacaataagagtagagatggtgagaatttgagttgtctctgcatgcaacttgcctatgtctttacattgacttcatgatggagtgttgctgacaacgtgatgattttctgggttcagtaacacctaattcatgctggacaggtcaggttgcatggccatttggtatctcatgattgagtgtttagtctaccagatcctagtaatacggttgcagttagtacaaaagaagagaaaaattgtttccagcgagggtttttcctcagggggcattcaatgagtgtttactatgattttcttccaggagcctgccattggctccactaagtaccctgatctgctacagtcatttcaagtactaatgggtccacaaagtcataagagctaagaggcagggatgcttttgctacagctttatcagctgtaaaactttgtctttctctggattccattcaaaactggcaaccttatagatggcttgctagtttagaaaaatatgccaaaagttgtatgttgcctaccaaattgaaataggaccgtggtgtgcactttatctttcttagttgtgggcaatgcaaggtacagcaagttgcctttcactgtggcaaagatattataatgttatttagtccactgagcactatattttaatgggtttatcttggacctttttatttacttgtgtcttagcaagaccactaggttaattgcttttagttagtgttcataaaattctatctttaaaaaataatcagtataagagtaaaacttgacttactgtggaatggtgaaatcattatcattcctatagactaaattatgacacagagatagaattaccacacatagctcacatactacacaaaaactgacatatcacaagacaggaaagtgaaaatatactgctgtccatgcccagtgaaagcaaactgtttctggtattctctatatagtatgatggagaggaaaaatagtccagctgcatactaagctgaagggcttaatttgctctgttatgagacaatatttggttcagcagcttgaatttgagtaactattgcttaaactctccctaatctactattcttctgtaagtcttattgattttctgtacagactgaaaggcaaattgaaagaggacacataagggaccaaaatcactgcatcttttaagtaattaatagtggcactaatatacagattcccactggagatatcatgctgctttggtcttactcatcttagggaaggggaattccacagacaccaaattggcctgtggttccatctagtcctcactccgtgattcagagtcaatgtagggattttgctagttgttgagtatacccatttcagtttacactctgatactgagcaacaggagaatgtgtttaccatgagacagacccaggccctcactctgagtggggtttccacagtagcattctaggtctccagggattagcagaaccagagtctgacagtaagtccacgtatttctctctcaatactcaaagaaattagtagatagtcacaagctcctggcaaaggccaggagaaagaattacagaatagtctttgatggtttcttggggttctttctcaaacatatctgattttccattctttcaggaaccatgagtacattaatttattcaggtcttataattgattgaagaaccatgacatggctcaacactcaatgtgacattctacaagggtcaagttattcaacttatatttgctatacctaaatatttttggatatgtaataatttgggtcattagagaatttattattaattagttaccaccaaaaattctggtggttttatactcactagttgtaagatcttagataagtgtcataagatttaaatgccttagtttccttatctgtaaaacagattatagtacctgtctcatggattaattctgtggattaattgtgagaacaattaaagtggttagaatagtatcaagcacaaaataagtgttcaataagtgatagctattatttttattgaatgtagatcaatatctttagtttgccaataaaagcccttcatcctcttattatcatcttacccttcactgttattttacaccaaccacgtttcatttttgcttagctggattacatcatgttttctgacaagtctctcacttctgtgttttgacatctttttctgacatgtcctttcatggaacactgcttattggatttcacacattttccgatgttcatatcaagtgctactgccattgtgaattctttcttgctattttcctgtctgaatatgatctctcttctcaaaaatcttcattatagttttttggggaatatctcattaattaattaattgatggaagaattaaacccattttgaataggtaaccacctgtaccatatttaaggagaccctttctgtgagaggagcttgcaaatttctaagagaaatagttgtataaatagatgattcaaatacagtggtttgatgttattagagtaatgctcagagttttctaaaagttcagaagatagggtacctagctccaaaatgggaagtcagtaaggcttcttggagaaagtgatgtcagaaccaagttgtgaaaatgttttgaaattaaccaggcaatgttcagcaggacagaataacacaagcaatgttcagcgatcgatatgcagttcagaatttctgtagtgaactcatgatggtggattaagggaagggatactgaagaggtaggtactggaaaggtagaatcccaaggaactctgtataagagagtaaagaacttgcacacattcataagtgtcattgaaggcttttcagcagtttttgatatagacagttcatcttgacagtagtattgaggtggtgctttgaggcagaaaggccaattagaagtatattgccatcattcaggtgagagatagaaagggtaggaatagtagggacagatggaaaagagggaataaatatgaaaattattcatgagaaaaatcagaatggctttatgatcaattaattctgggagatgaggaaaaggatggcgctaaatatatctttaacattttaaggacagtaacagggaggttgttacagaatatttcctgaatttgaaactatatgtagtgtaggagacaaaagagcaggattataatgtttataatgtgcacattcctgatcatgcagtggcttttaagttcccatattaaacacagatataaacatctgaggtgaaaatgtgagtacaatgacaaaggagaatatacgtttatggagtcatgtccaccaaagtctctacagcagtatccccttatctgtgggaggtacattccaagacccccagtgattgcctgaaaccatggagcgcaccaaactctctctgtgtcataccatttttttccatctgatacagctgctaagtgactaatgggtgggtagctggacaaaaggaggattcacatcccaggaaggatgccacaggatggtgtgagatttcatcacactactcagaatggcatctaatttaacatttatgaattgtttatttctgaaattttccacttaatattttcagaccgaggttgaccgtgggtaactgaaacagcagaaagtaaaactgcggataaaggaggactacatatctctttatttggttgttcatatcatcttatttgatattgatagagaaagctgctaaggtagaaaatattcataatcttaattaaaaagggagaaatggagaaaaaggaagaagggaaaaaaggagaaaaatcaaataaaaataatgaattgaattttttttttttttttgagatggcgttttgctctgtcgcccaggccggagtgcagtggcgggatctcggctcattgcaagctccacctcctgggttcacgccaatgaattgaatgttttaattcatatggaagttgagtttacttgaatacaatttttttttaacaattggaattggtgactgtcataatgtgaaaagcagttagctaataggataatgaaaaactgctttcaatgaaaaaattgactaatctctaccatcattcttttttgtaaagcatttatgtaaattattccatactgaagatctatttctgtttggaaacattgatggcagaatgaaagatgtactgaacggggaccacaaagcctggtttctagcactatcctatcataccctcaacaaaacaaataactagagctctttaatctcttcataaaaataaatgcgttgtttaagttctctaaagtctgtatctgttcaacacattggctttatagtgaggactagacttccttgattctttttcagttactgacattcataatctcctgacattcacaatcaaatttactgcggctctgaaatattcaccttctcattcagaaatgcttgtgaaaagagaagaagcatatggcaactggtctcagacatggttgcccatgaagtgcttatatcaatcaaatataatataatataatggtaccaaattaaggctctggaatgaataattttaatttcctctaggctaatattgacactgctacaatgacaatggctacaatgacaatggctacaattccacaaacagtccattaaggcatagtattagtaagttaaagggttaatacaatttttaaaaatgtactagtcaacttttaaggacagaatgaaatgaaatggaaatggagtacaagatgaatgtaattagaacgtattttacagagtagacgttttagaaatacaggttaaatacatctaaaaaaatagcacaaaaggcttggcttactttttcctctacattttaaactgaaatttttcattatgatcagtgttctttttcagagatgagtagctacatctgcctttagcagtacaaaaacccacatttcctcagtctctgttattaccaccattgtacgaagtagccagtgttcaattattacctgtcactaacaacctcaaactatagattgaagaggttaattttcagtttattttactctatatgtgagtgctgagtaataatgctagtcttgaaattttttgaaaagagaaaatcctttcttgctagaggaaatttaagctcattgggatgaaaacagtagttatactattatttgcagagcataaaatatttaaaattaagaaatttttagaaactttgtgttagccaaaactggcttcaaaactcattgaattgtataataattcatatgaaaatgtatgtaagactaacccaaggaagaaatgatacagatgatctatttttcaggatttgttttttttttttgtacagcttcatgtacaatctctatagatacaagggaggaaataggttgctcacaaaacttaaattcagtggggtactgattagatttttgaacttatgtttagttcctaaataacttttcttttgccagaccaccatgtccttgaaaagttaattttgttttatctccggatacaggaggcttcacatgacaatggcagttgaaagcttcccaggtaaagatccttcaaagaataagcaactcatgatagggaaggataaaagtcaacagtttataccactcaactgcttttaagattttcatcaaatgcatcccctgcagttgaaacttactagagaagcttcccagcagagttaaaatcataaaacaatgacaatgttacctttgtttctctgagcttttagacaggaaagacagccaccgaactgtgtatcaacttactttcttccccttctggtgttgaaaaaaaaaaaatctcttaccctgaggtacatgccattataccacaatttaagaaaagatagtttttgtaatcagctagaaaatacaactttattctaaaagtgtttgtattttatggtttctggtatgaatatgtgatgtatttactcaagggcaaaatcttccatagcacaaaaatggagttcattgcaattttaaaagtaaatattaacttgtgagttaaaaaatttttttactaataccttttcattatgcctagaatttgacattttaaaatatgtacatatcatggcaaagactatagcatatttaaacataagtattggcaaatatgaagagggctgtattttcttatttctgagatgttgccagtccatgatctcacgctgaccactgctccggaaattatcataagtcagtaaaagaaggcttttgtccattcccttgtgtgtatgataggtttcctcttgggagcaaaggtatgaagggagcacagtttgatactatccttaaaatgcaaagtacagttttgagttgagaagctttattaaaatccatactgtagctgcttcaccaaatagacacagaatgctggactagacttgctttatgttacactgcaagctaataaaagctgaaattagttctcttggatattcactgagtagaagtttcgctgttgaattgcctttttaagatattttaaaaagtccttgatgtcagcacaaaggagacactgctataaggttcagtaggacaaactatattaatctggctaaatttcaactgggttaatgatattttgtctccttaaattcttttgaataacatacttttctttattcatataaatgccatattcagaggtgacagcgtgctggcagtcctcacagcccctcgctcgctctgggcacctcctctgcccgggctcccactttggcggcatttgaggagcccttcagcccaccactgcactgtgggagcccctttctgggctggccaaggctggagcccactccctcagcttgcagggaggtgtggagggagaggcgcgagcaggaactggggctgcacgcagcgcttgcgggccagctggagttccgggtgggcatgggcttggcggccccacacttggagcagccggccggccctgccggccccgggcaatgaggggcttagcacccgggccagcggctgcggagggtgtactgggtcccccagcagtgccagccaaccggcgctgcgctcgatttctcaccgggccttagttgccttcccgcagggcagggctcgggacctgcagcccgccatgcctgagcctcccaccccctccgtgggctcctgtgcagcccgggcctcccggatgagcgccaccccctgctccacggtgcccagtcccatcgaccacccaagggctgaggagtgcgggcccatggcacaggactggcaggcagctccacctgcagcccctgtgcgggatccactgggggaagccagctgggctcctgagtttggtggggacgtggagaatctttatgtctagctccgggattgtaaatacaccaatgggcactctgtatctagctcaaggtttgtaaacataccaatcagcagcctgtgactagctcagggtttgtgaatgcaccaatccacactctgtatctagctactctggtggtgctttggaaaacctttgtgtggatactctatctaactaatctggtggggaggtggagaacctttgtgtctagctcagggattgtaaacgcaccaatcagtgccctgtcaaaacagaccactgggctctaccaatcagcaggatgtgggtggggcccgataagagaataaaagcaggctgccccagccagcagtggcaacacgcccgggtctccttccacactgtggaagctttgttctttcgctctgtgcaataaatcttgctaccgctcactctttgggtccatgctgcttttatgagctgtaacactcaccgtgaaggtctgcagcttcactcctgaagccagtgagaccacgagcccgccgggaggaacgaacaactccagacatgctgccttaagagctgtaacactcactgcgaaggtctgcagcttcactcccgaaccagcgagaccacgaacccaccagaaggaaaaaattctgaacacatccgaccatcagaagggacaaacgccagacgcgccaccttaagagctgtaacactcaccacgagggtccgcggcttcgttcttgaagtcagtgagacgaagaacccaccaattccggacacaatattgaacatctgttacatttcagttttaaaaaagtttttgaagtttaggaattgttatcacatcagttttctgtgtaaatggttttgattggaattaaatttaaaataaattattgtgcttttttgcggtagttcctctaacatgggtaaatacgaccaaggcaagtatattctactgtggttgaagtaatgctgaagctgcagtttaaaaacagtgtgaaaaatgagaacaattattgcatgtggccgaggtattgaaggagttaaacctgtaccactctggcattattgacaattttgaattaaaggtacttaaaaaaacagcaggtgcaagaagatcattgtgacctcttttctacttcttaaaagcggaagatgaaattcctatgtgaaagacactttccctgtaccaaaaggaataacattcttattttcatggatgaaaaattgagacccaaataattctgtacagactttgttaaaataactcctctcttttaagcctccccacataatttagttgcttcttcacaactcactgttgtttatccaactcggtattgaagtaactgactccaactgcttcattgggttttcatttccttatgaaggctctcgtgccacataaaacttgtattgagtaactttgtctgcttttctcctattaatctcttttatgtcagttaaattcttgggcccagccaggaccctaagaggatggagatggaattttgtccctggtatcgtattgaagaacttacacttttttactgcagtgtcttgtcctctgctcttcctgaggatggttcatatttgaagaaacggacacaattcttctaaacagagagaaaatattcaatgaggagttggatgggcccatcaattcttttgtcttctgtgaaaattacatactgctgcattttattgttcctgtggtggccaaggacattagctttactgtcaacaacattttgtctcctagtggctgttggtcatgtctctcagcttttcctccctcaacgatgtcactagacttgtcaattacaattattgcttccggcatttcttcactgattaggtttcataaactctccttacatagttcacccaaattcatgtgacctcttgctaatctcttagattttctgtctactaagggttgactagggacagagaaatgagctctaaggtcctttctctcataaccctattagttctccagtcacctgcaaaacgatgaagaaaattgacatttttttgaatctaatgtaaaagtgcaggaaagcatctctggacattttgtcttttttttttttttaaatctgtgacatataaacaacataaaagcagtacacttgcttctaaactgtaacttaaaaaaatcctctagtcccttccccagcaagcctgctgctcctaggccctgctatgtggaagttctgtggctctggcgaagctcccaggtagcctttgggacataaacaaggggactcagaaccagaagatgttagggttcctttcagaagctaccagatgtcctctgagactaccagataggaaagagacttgaagggaaggtagggttgtgtgttaagcagatataaacagggcatacgccagtggaattttaattacgactgctaataatagtaattattatgtagaatttttaaaatttattttattttatttttccataatttattgggagatatatatatatatatatatatgccccagtttctttattcactcattgattaatgggcatttgggctggttccatggttttgcaattgtgaattgtgctgctataaacatgcgtatgcaagtatctttttcaaataatgacttcttttcctctgggtagatacccagtagtgggattgctggatcaaagggtagttctattaatagttctttaagaatctccacaccattttccatagtggctgcactactttccattcccaccagcagtgtagaagtgttccctgttccctgcatccacgctaacatctactgttttttgattatggccattcttgcaggagtaaggtggtattgcactgtggttttgatttacatttccctaatcattagtgatgttgagcattttctcatatgtttattagtcatttgtatatcttcgtttgagaattgtctattcatgtacttagccctctttttgatgtgattggtttttttcttactgatttgtttgagttaattgcagattctggatattagtcctttctcagatgtgtagattgtgaagattttctcccactctgtgggttgtctgtttattctgctgactgttccttttgccatgcaaaagctctttagtttagttaggtcccagctatttatcttttgtttatattgcatttgcttttgggttcttggtcatgaaatccttgcccatgccaatgtctagaagggattttccaatgttatcttctagaatttttatagtttcaagtcttaggtttaagtctttactccatcttgagttgatttttgtataaggtgagagatgaggatccaatttcattctcctacatgtggctagccaaataccccagcaccatttgttagaaagggtgtcctttccctactttatgtttttgtttgctttcttgaagatcagttggctgtgacaggtgacaacgtgctagcagcccttgctcactctcggtgcctcctcggtctcagcatctgctctggccacgcttcaggagcccttcagcttgctgctgggctgtgggggcccctttctggggccagcggaggccagagctggctctctctgcttgcagggaggtgtggagggagaggcgtgggcaggagccagggctgcgcgcagtgctcacgggccagcatgggttctgggtgggcgcgggctcccaggggcctgcactgggcatggcaggctggccgcctgctgggcttgatgggggacaagctccctctgggctgttggagagtgcccaggctaggtgccacaaagtcctgccgcgaatgccattgagaggtgaagctggctgggcttctgggtcgggtggggacctggagaacttttctaactaaaggtttgtaaatgcaccaataagcactctatgtctagctaaaggtttgtaaatgcaccaatcagtgctctgtgtctagctaatcaggtaggggacttggagaacttttgtgtctagctaaaggattgtaaatgcaccaatcagcacttggtgtctagctaaaggtttgtaaacacaccaatcagctctctgtaaaatggaccaatcagcaggatgtgggtggggccagatatgggaataaaagcaggccacctgagccagcagcggcaacctgctcgggtcaccttccacgcccgtggaacgtttgttgtttcactcttcgcaataaattttgttgctgctcactgtttgggtctgcgtcacctttatgagctgttacactcacaacaaaggtctgcagcttcactcctgaagccagcgagaccatgaacccactgggagggacgaacaactccggacaggtggagcaaaccactccggacatgccacctttatgaactgtaacactcactgtgaaagtctgcagcttcagtcctgaggccagcgagaccatgaacccactggaaggaatgaacaatccagacgtgccgcctttaagagctgtaacactcaccgtgaaggtctgcagcttcactcctgaagtcagtgcgaccacggacccaccagaaggaagaaactctggacacatctgaacatctgaaggaacaacacatcatctttaagaactgtaacactcaccgcgatggtccatggcttcattcttgaagtcagcgagaccaagaacccaccaattccggacacataagtatttgggtttatttctgtgttctctattctgttacattggtctatgtgcctatttttatgccagtaccgtgctgttttggtgactgtggccttatagtatagtttaaaatcaggtagtgtgatgcctccagatttgttcttttgcttaatcttgctttggctatgcaggctcttttttggttccctatgaattttagaattgttttttctaattctgtgaggaatgatggtggtattttgatggggtttgcattgaatttgtagattccttatggcagtatgatcattttcacaatattgattctacccatccataagcatgggatgtgtttccatttgtttgtgtcatctattatttctttcagtagtgttttgtagttttccttgtagaggtctttcaactccttggttaggtgtattcctaagtattttatttatttatttattttgcagctattgcgaaaggggttgagttcttgatttgattcactgcttggtcgctgttggtgtatagaagaactaccgatttgtgtacattaatcttggacctggaaactttgctgaattcttttatcagttctaggagctttctggaggagtccttagggttttcaaggtaagcaatcacatcatcatcaaacagtgacagtctgattttctctttactgatttggatgccctttatttctttctcttgtctgattgctctggctaggacttccagtactatgttgaagaggagtggtgagagtgggcatccttgtcttgtcccagttctcagagggaatgttctcaacttttccccatttagtattacgttggctgtgggtttgttatagatggcttttattacattaaggtatgtgcctagtatgccgattttgctgagagttttaatcataaagggatgctggatttttcaaatgctttttctgcatcaattgagattatcatgtgatttttgtctttaattctgtttatgtggtgtatcacattcactgacttgagcatgttaaaccatccctgctccctggtatgaaaccaacttaatcatcatggtggattatctttttgatatgctgttggattcgggtaactagtattttcttaaaaattttagcatttgtgttcatcaaggatattggtctatagttttcttttttgtttgtgtcctttcctgatttcgatattaggctgatgctggcttcatggaatgagttagggaggattccttgtttctctattttgtggaatagtgtcaaaaggattggtaccaattcttctttgaatgtctggttgaattctgctgtgaatccatcttgttctggagtttctttgttgttgttggtaatttttaaattaccatttcaatcttgctgcttgttattgttctgttctgtatctaatttttcctgatttaagctcgaagggttgtatttttccaggaatttatcaatctcttctaggttttctagtttatgtgtgtaaaggtgttcatagtagccttgaatgatctattgtatttcagtggtgtcagttgtaatatctcctgttttgtttcttagtgaggttatttggattttctctcttcttttttggttaatcttgctaatggtctttcaattttatttatctttgcaaagaactagctttttgtttcatttatcttttgtattttttgtttcaatttcatttggttctgctctgatcttggttatttcctttcttctgctgggtttgggtttggtttgttcttgtttctctagttccttgagctatgaccttagattgtctgtttgtgctctttcagactttttgaagtaggcgtttagggctatgaacctcctgttggcatcttagaactgcctttgctgtatcccagaggttttgataggttgtgtgtcattattgtcattcagttcaaagaatttttaactttccatcttgatttcattttttacccaatgctcattcatgagcaagttatttaatttccatgtatttgcatggttttcaaggttccttttagagttgatttccagttttattccactgtggtatgagagagtgcttgatataatttcaattttctttaatttattgaggctcattatatggtctgtcttggagagagttccatgtgctgttgaatagaatgcatattctgtggttgttggataaaatgttctgtatatatctattaagtccatttgttccaaggtttaaatccatggtttctttgttgactttctgtcttgatgacctgtctagtgctgtcactggagtattgaagtcccccaatattattgtgttgctctctatctcatttcttacgtctattagtaattgttttataaatttgggagctccagtattaggtgcatatatgtttaggattgtgatattttcctgttggacaagaccttttaccattatataatgtccctctttctgtcttttaaccgatgttgctttaaagtttgttttgtctgatataagaatagctaaccctgctctcttttggtgttcatttgcataaaatgtatttctccactcctttactttaagtttatgtgagtccttatgtgttaggtgagtcttcttaaggcagcagatggttggtgagttcttatccattctgcagttctgtatcttttaagtggagccttttggccatttacattcaatgttagtattgaaatgtgaggtaacgttgcattcattgtgctctttgttgcttgtgtacttcgggtttttttgttttttgcttttgcttttcagcttttatttttgtttcataggtcctgtgtgatttatgctttaaagagattctgttttgatgtgtttccaggatttgtttcaagatttagagctccttttagcagttcttgtagtggtgacttggtaatggcaaattctctcagcatttgtttgtctgaaaatgactgcatctttccttcatatatgatgcttagttctgctggatacgaaattcttggctgataattgttttgtttgaggaggcttaagatagggccccaatcccttctagcatgtagggtttctgctgagaaatctgctgttaatctgataggttttcttttataggttacctggtgctgctgtctcacagctcttaagaatctttccttcatcttaactttgaataacctgatgaaaatgtgcctaggtgaagatctttttgtgatgaatttcccaggtatcctttgtgcttcttgtatttagatgtctaggtctctagctaggctgggggagttttctttgattattcccccaaatatgttttccaagcttttataattctcttcttcctcaggaacactgattatgcttaggtttgatcatttaacataatcccagacttcttggaggctttgttcttattttcttattcttttttctttgtctttgttggattgggttaattcaaagagcatgtctttgagctctgaatttctttcttctacttgttctgttctatggctgggaatttccagagcatttcacatttgtaaaagtgtgcccaaagtttcctgactttttttattgttttttctttaattctctatttcagtgattatttctcctttcacttcttgtatctttattttggattttcttgcattgagctttgcttttatttatttattttttattgtttttttttgagacagagtcttgctctgtcacccaggctggagggcagtggcgagatctcagctcgctgcaatctccacctcctgggttcaagtgattctcctgctgcagcctcctgagtagttggggctacaggtgcccactaccacacccagctaatttttgtatttctagtagagacagagtttcaccatgttggccaggctggtctcaaactcctgacctcaggtgatctgcctgcctcagccttccaaagtgctgagattacaggcatgagctaccatgccgggcctgggctttgcctttctctggtccctccctgattagcttaataactaacctcttgaattctttttcaggtaaatcagggatttcttcttggtttgggtctattgctggtgaactagtatgatttttggggggtgttgaagagccttcagggttggttttctggttccttctcatttgggtaggctctgtcagagggaaggtctagggctgaaggctgttgttcaggttcttttgttccacggggtgttcctttgatgtagtgctctcccccttttcctatggatgtggcttcctgtgagctgaactgcagtgattgttgtctttcttctgggtctagccacctagcgagtctaccaggctctgagctggtactgggggttgtctgcacagaggagtcctatgatgggaaccgtctatggggtctctcagctgtggatataggcgcttgttccagtggtggtggcagaggggcctaatagactccgtgaggggtcttagctttggtggtttaatgctcctgccaggaggtggcgctttccggaaaacatcagctgtagtagtgtggaggactggcagggccctagaactcccaagattatataccctttgtcttcagctaccatggtgggtagagaaggaccatcagatcggggcggggctaggcatgcctgagctcagactctctttgggcaggtcttgcttcagctgctgtgggggatggaggtgagagtcccaggtcactggagttgtgtacctaggaggattagggttgcctctgctgagtcatgcaggttatcagggaagtggggaaaagccggcagtcatatgccgcacccagctcccacgcaaactgaaaggccggtctcactcccactgtgctcccccaacagctcagagtctttccaagaggagggcaagaggggcctgaaaatttacctgaggctatccgcctccccgctgccaaagaaaagggctttagttgttccccctctgcccctgcaccgtgaagtcggcctgctggattcacaacctctgtggacttctggccaggaggcttctcgcctcattcaaattgttacaaagttgggctagagaattctttctccctgtggagctttaccccctgcacctctggccacactcacgatggttccctgtggtgccaggcaggcatgggctgcttggggacccagcaagcttccagggcctttctgctgcttcctctacccctgtagttcacttggctctctaacttgactcagctccaagtcaagtcggaaacttctcccgcaaacagaccttcagcttctccagtgagggtgtgtgttcgggagagaagggtctccctttcccacttccacagttggggcactcacagtatttggggtgtctctggggtcctgcaggagcagtccgcttccttcatagggtctgtgggtcctctcgggattgctggtttgttcttgcagttgatctggagctaaaattcacaatgcaagcctcccgatgctgctctgtctggagctgcaatctagtcctgcctcctgtctgccatgatcccctccatctctgttattatgtagaaaattgaagtgacacctgccactgacattctgagttaactgtcaggtcatctgaaatgggaagaaatttatctttgattctgtgtgcaccaccctagggaagaataatgctagagttggatgtttaaggccacagagtattagagcagtggtcctcagacttgagcacacatttgaatctcctggaggactcattgaaacaaaaagtgtgcctaggagcggtggctcatgcctgtaatcccagcactttgggaggccgaggcgggcagatcacctgaggtcgggagtttgagactagcctgactaacatggagaaaccccgcctctactaaacgtacaaaattagcccggcatggcggtgcatgcctgtcatcccagctacttgggaggctgaggcaggagaattgcttgaacccgagaggcagaggttgtggtgagccaagatcgcgccattgcactccagcttgggcaacaagagtgaaattctgtctgaaacaaacaaacaaaatgattggactccacccccagagctttgactcagtaggtccgcagtagggaatctctagttcagaaagttaccaggtgacactgctgctgttcgtggtctggggatgacactttgaaaaccactggattacagtggaaatgaacacaagaagctgcgcagagaatggagcagggccctaaatagaatcaaaggatccaagtcccaattcttcatggaagggagtaaacagcaagagtttccttactgcaatgcctttagagcaggagtagggccaaagacaacttttgttgccatcattgtatccattaatgctgtgaaaagataagcaaaggaagttggaaatggagttctcacaggttatgcttaaacaaagatggagaactcaccacagctttctcctatctatagcatttttagcctgtgctactgaaaaatctcttttgcatttcgcacttgcatttttttaaattgagtttttttttttgaggcagagtctcgctctgttgcccaggctggagtgcagtggtgcgatgtcggctcactgcaacctccgcttcctgggttcacgccgttctcctgcctcagcctcctgagtagctgggactacaggcacccaccaccacgcctgggtaatttttttgtatttttagtagagacagggtttcaccgtgttagccaggatggtcttgatctcctgaccttgtgatccacccgcctcggcctcccaaagtgctgggattacaggcgtgagccaccatgcctggcctaaattaagttttaaaaagtactgtgaatataaatgcacttaggttaagtttcggttatccttaataattaatggcaagtttactgcaatctgaaaatagtaactatggtaaaatcaagcctcatggagactggaaacagatccaagcaagtccagggagctcagcagcaggaattcttggacatccccttttcagtggcgtggtggaggcagctgtagcatttcttctgaactgagcattcagtgacttcacattggatgctttaatttggtcaggctggaagcatttactccacagaaattatcagttgtcaatgctgcaaatcaaagatctcttctctacttcagcccattactcatttacttttaccagggcactttcacctgatgaaatagctgagaaaattctttttcttactctttctttagtgcctgacttataggcacagctaaaaaaaatcaggtggactgggatggcaccagagctttgtgacccctgaccaggtattagagggggatcagaccccaaaaccagcccaaactggaacaggatccctagttgccttcagttcatgactatatcattatagtgctaaaattcccaccccaaggagagaatctccaccatcttatgtatatgggctgtgtgaagatgcatgtttatgaatgaagcctgaacatgtggagtcccaccttacacatgctaacattcctctccaacccccagactcagtccttaaaaacctcacgttttttattacctggggagaaggggtctttagagcatgcgcttactcctccatctctggccagaaatgtttgccctttggtccagttgggtgttcttgctttgtgacccatacaaagtaggaagagagctcaattttccggtgatattacccttacgccactgcctttagttctcagtgtgcttttctttcacactgttaatcttttttctattttacagtttcatcttttaaaaaaacacaatttctccttttgccgctcctctagcattccttcaattatagctcttgaaaattatacgatttttgtacattccagctcaaatacccaagaaggggctacaatttgttatttttcttgtaccctctgtaactcactgaacaatctgtaaatggggtcttcagatcagatgcccactttcaaatcctctggggcaagctggtacattgtaccatatacagcgcacctgcagccaggactgtggaagggaaactttagaaggggctgtcgcctgttagaaaccctaaatgatgcatttagtgctgacgagtcgtttctatcccaaccaaatactgtgttctgttacattcattatcttagcctctagctttttgttttgctttttgcattttgacttttgttcaggtaattttttaaactggtccgatttcataagatcacagaatttctctccttttaaaaataccgataaaaaatgatgaaccagggtggagttggagatagggcaccatgcttcaaatgtaacagtagtgaatagtaaatacatggacatgtaagactcattttacaaatcttgtctacattacttatgatagctctctacttacttatggcactataaaaatagtttgtaatctaacagagctcaggagctaatgactcccttaaattctttgaccagaggtctattagaattctttattgctgggatcaaatttcatcacagctcatatgaccccaggatctccctccacacctatttgtttccttaagcctgtggtgatagacctcacctaggcccgctgagcttagttccctcaggccatgtggagcagaagatacatgatggtccattcttacatgatggtcatcaaaatgtaattacaatgtggctgtgcatgcaggatgcctactcattattacataacctttgggtaatgcagtaatatagcattggaagcatacaggaaactgtacttatgccctggaagttatgatttgggtaatttggtttatcaatgttgtttcacaaccgtaagaggtaattatgacaagtctggggaataaaacatgcagagagctccagccctggctttcatttccagcatgtcttcctcctgagtgaactgaaaaccaccactaaatctgagagtatctctcatgagtgaaagggctgcactgcttactgaacatccctggcttgatgtcatttgactgcctttgcaaaaatctctaaccttggagttgattgctttaaaatgcaacttacataaaacttatgtgtgagaatgctccttttaaaaattttattttatgttcaggggtccatgtgcaggtttgttatatagataaacttgtgtcacagaggcttattgtacagattattttgtcacgcatgtgttaagcctagtacccattagttacttttcctgatcgtctccctccttccatgctccacgcctaggtaggccccagtgtctgttgttcctatctatgtgtccatctgtcctcatcatttagctcccacttacaagtgagagaacatgcaaaatatttggttttctgtacttagtttgctaaggatactggcctccagctccatccatgttcctgcaaaggacatgatctcattcttttttaatggctgcatagtattccctggtgtatatgtaccacattttctttatccaataccattgatgggcatttagtttgatttcatgtctctgctgttgtgaatagtgccacagtgaacataacacatgcatgtgtcttatggtggaaagaattgtatttccttgggtagatacctagtaatgggattgctgggttggatgacggtttttttttttttttttttttttgacagagtctcactctgttgtcaggctggagtgcagtggtgcaatctcggctcactgcaatctctctcccgggttcaagcggttctcctgcctcagcctcctgagtagctgggactacaggcacgcaccaccatgcccagctaatttttgtatttttagtagagacagggtttcaccatgttggccaggatggtcttgatctcttgaccttgtgatccacccgcctcggcctcccaaagtgctgggattgcaaggcgtgagccactgtgcccagccgatagttctgtttttagttatttgaggaaccaccactctgctttccacatggttgaactaatttacactcccaccagcagtggataagcattcccttttctctgtaacctcgccagcatctgttattttttgacttttaaaaaatagccattctagtggagcgaaatggtacctcattttggttttgatttagataatgttctttttcaacaagctccaaattcagtcttcagcggaatgaattcaccagtttccactttacctcataattacatcacttggagtacaatctacacttcttctgtatctttagttatttcagcagcaattttcatgattttcagtcttttccctgttgttcagtttcccagactttatagatttttgttttaaattcacattgttggctgggtgcggcggcttacgcctataatcccagcactttgggaggccgaggcgggtggatcacgaggtcaggagatagagacgaccctggctaacatggtgaaaccccgtctctactaaaaaaatacaaaaaattagccgggcatggtgacgggcgtctgtagtcccagctactcgggaggctgaggcaggagaatgacgtgaacccaggaggcagagcttgcagtgagcccagatcacgccattgcactcaaagcgtgggtgacagggcgagactctgcctcaaaaaaaaaaaaaataaataaataaaaataaataaataaataaataaattcacattgtcagaccagaatgactaccccttgaacataaacatcatgtggcattgctcaggctctggagagatctctaacagctttgtccttttctgattctctactcagtatctaccagtcctcccacaatgctccctgagtttctaacttcccattcccttctcacaaagaccttcaatttctaaaacttgtctatgcgttctcttctcgactccctctttatcttagactattttcagtctttttggttttgccctgcaggtttctggactccttttacccatcttcaccctcccagccctcatcaccctatttatttactgtggctgatgttcaaacctgctggaggcatatgtggagcatgcattcttcctgttcaacctgttcttcctgttcgaccaggcaaagttcttactgagacctgggcatgtaattttcttgccccagaaggtctccaccttctatatgttcttatctactgtcagctcaattctagctcataccctttgctcaatattctttattcaatatattgaataacatcttcaagatgtgtatttacataaggcataagataactaattctataagaaaagaagcaaatgtgggaagtgttgtttcatcacatcttacattatgattgcatgttatctaatttgactgccttcggatcactttttttttcttgtgtctttgtcctttttcaagcatggtgtactttagactctgaatatatttcttttttctttttctttttctttttttttttttttgagatggagtctcactctgtcaccccaggctggagtgcagtggttctatcttggctcactgcaattttcgcctctcaggttcaagcgattctcctgcctctgcctcccaaggagctggaattacaggcgcgcgccaccataggcagctgatttttgtatttttagtggagatgggatttcaccatgttggtcaggctggtctcaaactcctgaccttaggtgatccacccgccttggcctcccaaagtgctgggattacaggcgtgagccaccgtgcccggccctgactgtgaatatatttctaattgaaacttgcattcatagaatctgtgtgcagagactgaaaactgtttcattaagtaaatatcagtgacttccgctgaggtcagtggctgaagagccgctcttgtatgaagacttggaaagacacctttgctttttgattataaccagaaaatactcataattctgcactggtacctatggtggtagtagtttgtaaacctcttggtcatatagataaaaggaatgaggtaatactcccttataaatggataaaatgataatgcattttagtattagtaggaatgagaggtgacaaatacataattacataagtacatagtaagcagaaagggtgggaattttctgttcagactcaggagctggtacatgtttagactggtttgattgttgtttctggtggacagctctaaaaatttggtagttactgcatttttagtctttttttttccagatctaagaaaaaaattagcctttggtctttggaaaacagaaaagtgctaacttgaagtatggtatatgtaatctagtatgcctaccaaataacatcttcatttttaaaactaggagttacataataaaatggtgtcttagtgcatttgatctgctataacaaaaataccatggactaggtatgcttaaataaacatttatttctcatagttctagaggccagaaagtctgagattagggtgcgggatggttgggttctgaggagggtcctactctgggtgggaaactgccaacttctccatgtatcctcatgtggtagaacaggctgagggttctccgcggactcttttataaggggactagcctgctcatgagcactccacctcatgagctaaaacccaaaagccacatctcctaccaccaccacactgggaattaggattgtaacatatgaattttggggagacacatttagtccctgatacaaggaatattttgttttatttttattttatgtatttatttattttgagacggagtctcactctgtcgcttaggctggagtgcagtggcgcgatctctgctcactgcaagctccacctcctgggttcacgccattctcctgcctcagcttcccgagtagctgggactccaggcgcctgccaccacgcccggctaatttttttgtatttttagtagagacgcggtttcaccgtgttcgccaggttggtcttgatctcctgacctcgtgatccgcccgcctctgcctcccaaagtgctgggattacaggtgtgagccactgcgcctggccacaaggaatattttaataggatatttttataacaaaaatattttctatttagaagatacagtattctggtgacatagatacaaggtgttatttttttattcagttagatagcatccttctaataattattttccataattgaaatcaaacacttctcgaaaaataactggcaaattaggatcagttagcaaaaaaggaaaacgatgaagagattacttgagttttaaagaatggagggaatagaaaaaaaattgtgccatgaagacactgtaacgtaaacatcttatgattttaaataaggaactcagatttcataagtcaaggccagtgagaacaaagatactttactgtacattgctattaaagagtcacactgttacattaaaaaaaaaaagaagaataattaggccgggcccagtggctcatgcctgcaatcccagcactttgggaggcccaggtgggtggatcacgaggttaggagttcaagatcagcctggccaagatggcaaaaccctgtctctactaaaaatacaaaaaaaaaaactttagctgggcatggtggtgggtgcctgtaatcctagctactcgggaggctgaggcagacaattgcttaaacccgggaggcggaggatgcagagagctgagatcatgccactgcactctagcctgggcaacagagcgaaactccatctcaaaaaaaaaaaaaaaagaataatgaaaagccacacagtagaatatgaaccaacttgaatcttctggggacatgctagagtttagttacataagataattgatttttaaaaatgttttattaaaaccatttactgattttttatagcaaattagaaaattcttatagtgcctgtgagaattgcttttcattattagagaagatttttactaatgataatatataggctttttacttgaaggatgcagacagaaagaattctcaaacttcagagaaacaaatttggttggattacagatatttttgtaatgaaggtcacaattgtgggttaaattacaatgtccatagagcattttgtgagagaaagtcagtcattaaatctcaaagcatatttgtatggaaagatccataattcctgtattgaacaaaccttttctaagctcttatattagaaaaggctgccttccaaagatgtggtggctacacatgaggaatatactgttttaatgctatagctaggatactgaaatactaaccaagaatttttatagattgaatttgcaagctgaaaatagcctaaatttatacactacatgtggaacttatgtccagatagaaatatctataaacatacaggatgacagcaatttgtacttttatttaagaccgcaaatcagtttttacattcttttttttttgagatggagtcttactctgtctccaggctggagtgcagtggcacgatcttggctcactgcaacctccacctcccaggttcaagcgattctcctgcctcagcctcccaagtagctgggactacaggcgtgtgccaccacgcccagctaatttttgtatttttagcagagatggggtttcgccatattgtccaggattgtctctatctctttacctcgtgatctgcctgcctcggcctcccaaagtgttgggattacaggtgtgagccactgcacctggccagtttttacattcttaaattatataactttacatatagccacatacgactgaattcaccactattgaaaatcaggcttggcatggtgtctcacacctgtaatcccagcactttgggaggccgaggcgggtggatcacttgaggccaggagtttgagactagcctggctaacatggtgaaatgccatctctactaaaaatacaaaaaaaaattagctgggcatggtggtgagtgcctgtaatcccagctactcgggaggctgaggcaggagaatcagttgaacctggaaggcggaggttgcagtgagccaagatagtgccattgcactccagcctaggtgacactagttcttagtgaaacagtgtctcaaaaaaaaaaaaaaagaagaaaaaagaaaaacaaaaagaaaattatctgtgagttaaccattgtataattcaagtttaaaacaattttgatgcattctaaataaccttaaaatgttcagaatgaacttgaaactataatatacttttttggaaagaagttatgttacaaaagaacctgctgtcagttggtagtgagatgaattatttatgttgcaaagaactcttgtgggttgcatccttcctgatagtggagagggaaggagatgtagttggtaactgagccaagaaatctctgatagggataattcaattgccctttggagggaatgaatatgatgttatgataatgataatccaagacctgttaaaccttttaaaattattctgggcctggtgcatgactcacacctgtaatcccagtactttgggaggccaaggcaggaggatcacttgagcccaggagttcaagaccaccctgggcaacatagggagaccccatctctacaaaaaataacttctaaaaaattagttggggctgggtacggtggctcacacttgtaatcccagcactctgggaggccgaggtgggtggatcacaaggtcaagagatcgagaccatcctgaccaacatggtgaaatcctgtctctactaaaaatacaaaaattagctgggcgtggtggcgggcgcctgtagtcccagctacttgggaggctgaggcaggagaatcacttgaacttgggaggcagaggttgtagtgagccgagattgcgccactgcactgcagcctggcgacagagtgagactcccatctcaaaaaaaaaaaaaaaagaaaaaaagaaaaaaaaattagttgggcatggtggcacatgtatgtggtccctgctactccagaggctgaggtaggagaatcacttgagcctgggaggtcaaggctgcagtaagccatgattccgccactgcactccagcctgggtaatagagtaagaccctgtctcaaaaaataaaataaaatcaaggaaataaaataaaaacattctgtttcttaaactgggcatatataccaggtagttgatgcattggattattgtaagcaagtaggtaaacttagcttttcttcctggaaaatcaacattattggaagatttttaaaaattaaacactcattctgtagtagaatgtgctatttgcataaaatataacaagaagtctcaaagaagcttgaagcttatagctctcctttccatttctccccttgattcctgcaaatgtacaagtcaatctcccctacttttagagggacttgaagtgtttgagaagcaatgatatacaacttaatctttacaatggcccctgagatattgatttttcatggttgaaaagagagactctgagaaattaagcaatttgttgggcttcagatctaagaatctaattcagtgatagctccccctctgacctgctgcttccctacaattctaaaaggattttcattcctataactttgtttaaatatcataaatactgttgagtattataatttccattttataaaagggaaaccaaggctcagttatgatgggacatactcccagatatactaagtatcagagctaaaatcagacctgggttcttgatttccaggacagaggcttttcttcttcacagaagcaatcaactataacatgaaactaactatagccattcaatgctcggttggagacacagatccttgtcaactgactggacataattcttgtactagtagtagtaataatgaatgtaaatatgttggtttacattcttcaaaggtctttttgcatacatattatctcatttaattctccctgttacccccatgacaagagttctgttaatccctttaataggaagaggaattaacctttatttagcttctacggggcacaatactaacatcttaagaaaggtaatctcatattatattcataacctcatattgccatcataattgtcatttgttgcggaaattgaggctcagaggagttaaattatcatcatcttgtgtagctagtaaatttagtgaaaataaaatgtagtaggattgagtaaaatcctctaatgcaaatatcaatctctttttttactatataatatttgtctcataacatctggtgaagtctattattctgccttgctctattctcacagatgttcctgaagcagatgatatatccttacgaaattcaactgctctcaggcactgcaggacatcccttctcttacttatgagaaagttacttcctttgggaggagaaagttttccagtgaattacttgctcatgaataatttattacttttctccccctattcttctatcagcatatctctttaggatatttgaatataacaggcagtttatcgctccaggtgattgttaatacaaataaatctctggtatttcaggcaatggaaccaagcaaaggggagatggggagattgacaggcagaatggggaagacatatgggggcactggacaattcctggttacctaaaaccacactgtgcagattttgctcagcctttgcatcctcacgagttagcccaccctatggctcggtcattgggggaacatcagatgatattgtttcttattagagatactatgtacgaaataccaaagaccactctatttccttagacttatgtggcctttctgggaagaggcaaatcttgtcaaaggagatagactaagaatatccacctatcaacactgatccaactggaaagaaacaatttgatttagataaagatagctacagcaaaaaattagcagggcctaggattctcgctgagtggcttgctattttgttagcaacatgttatttaacatgtttagtaaaataattgatctgatgcatttataaactctgttctggctcgtgatgcttaaaatgccgaggtgcttagtcgtttgattaaattgactagttgattagttaaatgtcattaatcaaaaagcatcattgagtgccttcatcgtgcatgggtccttgggggtggagtggcaatctgaaaatgtatgacctggcttctgttctcttttatgtttccagttgggttggacaatgacaaaataacaaataggcaactaactgttacatggatctatatgtgctaaaaaagtcgaatgggcaagaaatgctttataaagtctgtatacagtggtaatagctaccacagagaatatagttcatttagttctcagaatacccctatgaggtagatactatgtttatccctgttttagcaaggataaaattaagacatagaaaagttttaaaagttgcccaaggtcatagaagtaataagtgatgcagtgtgaatgcagaggagggtgtctgggttaagaactcaagtctctagctcctgttctctattgcctatctgtgagatgtcgcagaaatggtcaaatgtctctttaaaatatttaatatattgaagtttgttacagtgtacatttttacaaacatattgtataaaatgataatttaatgacattgctttgtttctcaattttcatgaaatgatttattcaaattctgagaagattgtttttaccataaggatctttatcatcatcagagacacagtttttagagcagattgtctttacatctatctaagttatctgaaaacaaagcactttctcagtatgtgtatgatactgtcactggaaaatttatacaaatgaacacactttttttcccatttgttctgtggttgtatttttttttttaatctctacaatgtaaccacttactatatgcttttaaaagtaattctgagacaggaatgataggaatgatacagagtggttgcagaatagaaaattccaggcagcagtttcatatgattagcaaaaaggatacagttgaaatagcatcataagctaggggctgataagaccctgaaaaccagcatgtgtgtgaagctccccaacaccgactggacccatcacagtgctggatttgactcagctttctcctagggcctcattatatgcccattagcctagaaatcacacaccctccagcaccatgacagttccaggaacacccatattttgtgtaaaaatggatggcatcacacttccaagaaatctccacctttttctgggaatattccaccccctggttaaagaaactcataaggataaaaccccaaacccccttgggagcgactcactcgcttgagtacgcctgcactcccctttcctgagtgtgtactttgacttcgcaatacatctcggtactttcactcttttctcacttgtccttgaattcctaactgcaacagtgtcaagaggttggacactggccggggtccaggtcccactggtgtttgggcacctcccctagcccattagtatcaattttaaaattattttctttaaattccaacactggcagttctgaggtcaaacttcgagaacaataatgaaatttacagtggctcacgcctgtaatcccagcactttgggaggccagggcgggtggatcacgaggtcaggagatggagaccatcctggctaacacggcgaaaccccgtctctactaaaaatacaaaaaattagccgggcatggtgacgggcgcctgtagtcccagctacttgggaggctgagccaggagaatgatgtgaacccgggaggtagagcttgcagtgagccgagatcgcaccactgcactccagcctgggcgacagagcaagactccatctcaaaaaaaaaaaaaaaaaaaaaagataaataatagataacatttatattacacttatttgcttttttttttttttttttaaaatggacttcatttgtcagtctttaagcacctgatactaacattgcgacaggtcatttcaggctatggtgttcttcccaaataactcattgttgttccaggttaagtctctgagaactatctcacaatgtggaagtcttggtaaggatttacatctaaggcagccattatatgagcaggcataagaaatggatgtattgaggcgattcaaacagaataagggaaaaaattaatataagtgtgaggccgggtgaggtgactcacacctgtaatcccagcactttgggaggccaaggtgggcagatcacgaggacaggagatggagaccatcctggctaacacggtgaaactccatctctactaaaaatacaaaaaattagctgtgcgtggaggcacgtgcctgctacttgggagactgctacttggtagtcccagctacttgggagactgaggcagaattgcttgaacccgggaagcggaggttgcagtgagctgagatcgaaccactgcactccagcctgggcgacagtgtgagacttcatctcaaaaaaaaaaaaaaaaaaaaaaaaaatatatatatatatatatatatatatacacacacacacacacatatatatacacacacacatatatatacatatgtatacgtgtatatatatacacatatatacatatatacacacatatatacgtatattatacacatatacatatatagtatatatacacatatatacgtatatatacacacatatatatacgtatgtatgtgtgtgtatatatatacatacacacatatatatgttcttgttgttcaactcccacttatgagtgggaacatgcggcgtttggttttctgttcctgtgttagtttgctgagaatgatagtttccagcttcattcatgtccctgcaaaggacatgaactcatcattttttatagctgcatagtattccatggtgtatatgtgccacattttatctatccagtctatcattgatgggcatttgggttggttccaagtgtttgctattgagaatagtgctgcaataaacatacatgtgcatgtgtctatatagtagaatgatttataatcctttgggtacatacccagtaatgggattgcttgttcaaatggcatttctagttctacatccttgaggaatcactacactgtcttccacagtggttgaactaatttacacacccaccaacagtataaaagcattcttatttctccaaatcctctccagcatctgttgtttcctgacttcttaatgatcgccattctaactggcatgggatggtatctcattgtggtgatgataagcttttttaaatatgttttttggccacataaatgtcttcttttgagaagtgtctgttcatatcctttgcccactttttgatggtttttttttgtctgtaaatttctttcagttccttgtagattctggatattagccctttgtcagatggatagattgcaaaaattttctcccattctgtaggttgcctgttcactctgatggtagtttcttttgctgttcagaagctctttagtttaattacatcccatttgtcattgcttttggtgttttagccatgaagtctttgcccatgcctatgttttgaatgttattgcctaggttttcttctaggtttttatggttttaggtcctatgtttaagtttttaatccatcttgagttaatttttgtataaggtgtgtaaggaaggggtccagtttcagttttctgcatatggctagccaatttttccaacaccatttcttaaataggaaattctttccccattgcttgtttttgtcaggtttgtcaaagatcagatggttgtagatgtgtggtgttatttctgaggcctctgttctgttccgttggtctatatatctgttttggtaccaataccatgctgttttggttactgtagccttgtagtatagtttgaagtcaggtagcatgatgcctccggctttgttcttttttgcttaggattgtcttggctatacaggctgtagttttttctaattctgtgaagaaagtcggtagcttgatggggatagcattgaatctataaattactttggggagtatgaccattttcacaatattccaagcagacctaatcggcatctacagaactctccaccccaaatcaacagaatatacattcttctcagcaccacatcacactcattctaaaaattgaccacataattggaagtaaaacacgcctcagcaaatgcaaaagaatggaaataataacaaacagtctctcagaccacagtgcaatcaaattagaatttaggattaagaaagtcactcaaaaccacacaactacatggaagctgaacaacctgctcctgaatgacaactgggtacttaacgaaattaaggcagaaataaataagttctttgaaaccaatcagaacaaaaacacaatgtatcagaatctctgggacacagctaaagcagtgtttagaaagaaatgtatagcactaaatgcccacaggagaaatcgggaaagatctaaaactgacaccctaacatcacaattaaaagaactggagaagcaagagcaaacaaattccaaagctagcagaagacaagaaataactaagatcagagcagaactaaaggagatagaaacacgaaaaacccttcaaaaaaagcagtgaatccagaagctggttttttgaagattatcaaaatagactgctagccagactaataaaggagaaaagagagaagaatcaaatagatacaataaaaaatgataaaggggatatcaccactgatcccacaaaaatacaaactaccatcagagaatactataaacacctctatgtgaataaactagaaaatctagaagaaatggatagatttctggacacttacaacctctcaagactaaaccaggaagaagtctaatccctgaatacaccaataacaagttctgaaattgaggcagtaattaattaatagcctaccaaccaaaaaaagcccaggaccagatggattcacagccgaattctaccagaggtacaaagaggagctggtaccattctttctgaaactattccaaacagtagaaaaagagggactccttcctaactcattttatgaggccagcatcatcctgataccaaaacctggcagagacacaacaaaaaaagaaaatttcaggccaatatccctgatgaacattgatgcaaaatcctcaataaaatactggcaaaccgaatccagcagcacatcaaaaagcttatccaccacggtcaagtcagcttcatccctgcgatgcaaggctggttcaacatatgcaaatcaataaacataatctatcacgtaatcagaaccaatgacaaaatcaaatgattatctcaatagatgcggaaaaggtctggctgggcgcagtggctcacgcctgtaatctcagcactttgagaggccgaggcaggcagatcacgacgtcaggagattgagatcatcctggccaacatggtgaaaccacacctctactaaaaatacaaaaattagctgggtgtggtggcaggtgcctgtaatcccagctattcaggaggctgaggaaggagaatcgcttgaaccaggaagcggaggttgcagtgagccgagatcacactactgcactccagcctggcaacagagtgagactccatctccaaaacaacgacagcaaaaaacaaaaggccttcaataaaattcaacaccccttcatgctaaaaactctcagtaaactaggtattgatggaacatatctcaaaataataagaactctgtgacaaacccacagccaatatcatactgaatgggcaaaagatggaagcatcccctttgaaaactggcacaaggatgccctctctcaccactcctattcaacatagtattggaagttctggccagggcaatcaggcaagagaaagaaataaaggttattcaaataggaagagagtgtgggagttcaatcaggctgctgagaaaaatattaaagatagttacaatagccacacacctttttggaaggcctgaaggtttttgcaaaagtctcaggataaggctacagctaaaggcaacctaatccttaccttaagtaaatagcttaaagtgggtacaaaggaaggtagagtaatttatctaattagcttgtttactcatgtggtcctaggactaacctttaatttaccgggtttcttaattgctttctacttgggaagtccacaatgtcaattaccctttagtggtgttgactcaagcctttgtcaattaatctttactgattaaacgtatgtctcactagctgattggggccatggtcgcaactgtttacagcactctggagtctgtaagcggcctggatgctcagccaaactggcaaagcagaatatctgtgtttcagtgtatttcattcatctgtcattgggtcagggtctgcaggacagacccctgcaagagaggaagtcaaattgtctctgtttgcagatgacatgattgtatatttagaaaaccccatcatctcagcccaaaatgtccttaagctgataagcaacttcagcaaaatctcaggatacaaaatcagtttgcaaaaattacaagcattcctatacaccaataatagacaaacagagccaaatcatgagtgaactcccattcacaattgctacaaagagaataaaatacctaggaatgcaatttacaagggatgtgaaggacctctgcaaggagagctacaaaccactgctcaaggaaataaaagaggacacaaacaaggctgggcgcgatggctcaagcctgtaatcccagcagtttgggaggccgaggcaggcggatcaaggaggtaaggagatgaagaccatcctggctagcacagtgaaaccccgtctctactaaaaatacaaaaaattagccgggagtggtggcgggcacctgtagtccaagctgcttgggaggctgaggcaggagaatggcgtgaacccgggaggtggagcttgcagtgagccgagatcatgacacagcacttcagcctgggcgacagagcgagactccgtctcaaaaaaaaaaaaaaaaaaaaaaagaggacacaaacaaatgggaaaacattccatgctcatgagtaggaagaattctttgattgattttattttattattattattattattttttgcctgaaattttctttttttgttgtgtctcgcccaggtacgatctcagctcactgcaagctccgcctcctggcttcacgccattctcctgcctcagcctcccgagtagctgggactacaggcgcccaccaccacgcccggctaattttttgtattggtcttgatctcctgacctcatgatcctcccaccttggcctctcaaagtactaggattacaggcgtgagccaccacgccaggcctggtttttttttttttaagaaaacatatatttattgagcttttaaaaaaaatttgccagggatggtgctactcatttgagattttaaagagaaaaaagtctcgcaagattctgaccctcatagaacttacctgtagtgtgttagacagaaaatgaacaaatgaaaaataattagaaatattataaagtatatgaaggaaataatgatgcattaaataagtaattaacagagggcctatttttaaaaaggtagtcaaaaaatggctgtatgattccatagacaataagagaaataattattttagctatctgatttatttgcccaatattcatttcccacttgtaggaatggcatttcagtctctttggggaacaaaccctctcccactcatagcccatgtccatgtttctggcttctgtggcttaggcctagatagtcgatattccctcaggctacaataatgtctttgatttaaggatgaacttttaacccaaatatgaaaatgaaatttgattcctaatctttaattgggtctatagggaaaaaaattctcttcccactggcataagctggaaggatgtaattgtggagcatccaagggccatgagatgagaactgattaagaaaggagggagtcagcatagacagaaacagagcccgtggaaggaaagaggtgatgcagatgacatcatttatctatcttgacgcagttgtaaattctctctcatgggatccaataaatgtccctgtccccactctcttttttaaacctaagtaagttaattttgtagatgagttagtagctgatatgtcaaatttgaggcaatgtaggctctcataccttagatctgtctatttggttgctgtgatacaggactgtgcctgtatcactggtaagattgtggcaaaattactctctctcaatttatctacattaatgtgccttagttttagcaatgaggagataatatatttaaagatgagaatatacacccacagacccagaaccacacacaatgtacacatattacagtgtatgtatatccaaaatatgtgtctatagaaatgtatactatatacatattatatatacaaatatacacatatatacttatatgtgtgtatatatgtgaatagactatttacatgtatatatacaaatatgttatatacacattatatactatatatatttatacacatatttaaacacatgcatgtatgtggatagagagatagcgagatagaaagatagatataaagagagaaagggaaagagagtgatccaagctctgatttaaatttagagttgggggaaaaaagaactctcaaagaaaatagagattgaagaataagagagacagaaggacgtcttacaaagtaaggaaagaaagattttagtatagaatttgttgttaaagtcttcagcatcttcagtggtcatatcaggatctgctattattttccatctctgattccctactccagtcatgtgttcacttttgcctctaccagtagcctcagagatgagttcctgctcttggcaaaaaacactgaaaagcaccctttgccccagctgtggatcactgggttttgctagcagcgaatcctcagatgctggcttttaacaccctgggaaacaacatttagctgtatatgcagtctgccgcctgacattttttgaacttattctatctttcctgattctaatcgggtctttggttttggtgcccatctggcatatgaacactatgcttgcctaaaatttttgatggataggtttgttttatcctcgggatgtattgtctgagactgacatcatctagcctctggggctccttaaaattttgccatgtattctggagcactgattacctatttgatccttgtgtttgttcaacgcttatggcctggcatgaaatacagagaatggggagtaaaacgaataattaaattttccctgaagaacattaacaatgcaatttccagaaattggaggggttagaagcactgagaaacttttgatttgtcacacattctagataatctaaatatgaaaattagaacataaaaagcaatatcgtatttttctatacagaagagctgcaagaagtaaagggtaatttgctgcatttgtagtgggagcaaaaaggtatgtaatgaaaaccttcttttagaagctccaaagtagagaatgggtgtagccaattgccaacagggaacacaaaattgattgtggcttgtcaaattggaggcatataatgcatgatgtagtagcgactgcacaagtctccctcattgtaaaacctgatcacactcctcatgtaatctatatttaaatcttttgggaatcatgacacaaatatgcccacccccaattgttaaattgtcaacttacactgagcatactctagctgtcagactgatccgtgggcgccagctgacctagaaagcaggacacagagagccgcgcttgaagttgagaattaaactgagggctggactgaaaagagtatatgaaaccaaggtggaccaagaagtcagaggtgtaaagcagtagaaggtcaaggctatgtaatttctcaaaagccaaagactacatgcagttgtaggccaagctggggcagtctgcaaaacaggcaagtcataagggaggaggggacaatgaagcagagacaggcgtgacgcaggcagagttcctcattcactcctcactcttgcaagagccaaaatttgatatctgggcaggcatgagggcagcccaagccttagggcctcagggcaggcacgagggcgtcaggtcttcggcagtctgatctacttcagtctcagatgaatgtgaacaggaatataatacctgacccagtcagccaggcatttgatacaaaaatgaattgaacaaaaattaattaaccttcatttctattgaggttttgtagcaatatctcatatgaaaatatctactctccttaggtataacttacttttcttagtattcctagaaataggaaaatttcttcttatatttaaagtgaaggcatattagttaaagtaactaatttaattcgtcatgtgcttaaatgtcaagtactttatattgcttactttttccattctctgagtttggcttcttatcctcacattaggatgagagctattcacttgtttttttcaaagttatatcactagtaatggtagattcttggaagacctgtggttttgagttctctctcctaaagaatgtatatatgaagtatgtatttatatgaatactctctatgtagtttgtatatttcttttttttttctttctttttttgagacggagtctcgctctgtcgcccaggctggagtgcagtggcgtgatctcagctcactgcaagctccgcctcccaggttcacgccattctcctgcctcagcctcccgagtagcttggactacaggcgcccgccactacgcccagctaattttttgtatatttagtatagacggggtttcaccatgttagccaggatggtctcgatctcctgaccttgtaatccaacctcctccccggcttcccaaagtgctgggattacaggcatgagccacggcgcctggccagtttgtatatttcaaacttcaaatttccaagcctgtgttcaaatgatcttgacaaaggaaagttaatttaccacttaattgtggcttgatcaacacttttaaggcagctgctatcaaaagagtggctattgtttcatatatgaaatagtcagaaattagattatgcatagacatggaaatgggaaaggagcagaacataacctgtatcctgtatgaactttaattcctaacctttaattggacctatagggaaaaaacattctctttccactggcataacttggaaggatgtaattgtggagcatccaagggccatgagatgagaactgatctctgtatcctaattcagtgacagaaaaataacccttaaatcatgaattactggctgctgtaaatgaaggtgattagaggttcctctggttggggaagggatgaagaaatgtaccccgtaaattgtcacaggtaacaccatacaccactctgaccatcacaaacagctacttgaattactgagcaaccgcccaactcatcctttcaaagcggaccctcacactggctcagtaaaagaaatcatttgcctgcttaaagatgatctggagataaattgttgcaggtctctccatgatattgttgcaattacagctcagactcacaatagaatatacagtacttgttgtgagagacaatgactcttgttcctttaggtatccttatttgttgttaacagttgccaattgtgatcttcctctgataatctcaagccatagaacatttgggaggggtgaccaggcttccttggttcagtcaaactggacctatcttacattttactagatagaatatcatatatatatatatatatatatatatattttttttttttttttgcctgtgtctgcactcctgttgtgttattctgaaatgggtttgtctacattggctagtggaaaaaatagcacaaggagatgtttgcttaaattaacatctctccttctgccctgtccctctctatcccacattccatctgcacagtagaatgacaaagcaatgcaaccattcatagtaccaaaagattttgttgaagatatttgcatatagaaagtcctagtcattctcatatgaagaggacagaacaaaactcaatatatcttttattataaattacattagcaattgtggtaattcgtatttctttggaatgcttatatcttgtggcaacagttatctgaagggaaaaaggatgcatatacatcctggtttttcttgcaattgttagacttattccacaacatttatggcaccaacatttatgcctcattatcattattctacttttctgcctctttaatagcaactgaactctgaggaaagaaatgatttcaggatccttttggccctttcttaacactgaacctcaatgtttgaaaataaatttttaaaatgtatattctggattttaatgataaatcttgaaatatctgtccactgtcttcatttcagcattcaaatccttcagtgttatcttttcttttttttttaatgcaaagctaatatggtttctcttaattttttagaaaaattaactaaaattttggcattgctttatcatcttggcttattgtgtaccctctctcattggaagttagcctctttttattatattaataggcagacattaaaatgtggttgttttttcaatgaatgaatagactttcagctgttccctttcccacatgagcttacagtaaagaagttcccacttgcttcttgcaaatatgtttctacttgccatttttaaattactgttgcctttggatgtgggagaatgtcttcctttgtcaaaatggcaataggaggcacaagtgacaatcccttttccttaagatttgggactgcacaaagctgtcagtttttaaaatgacactgtgccacagcctttctctaaggtggtgcctttcatttttgactcctgctgttcttgacagttgaaatggcagcaggaggtagaaactaaagtaagttctcttggcatttgcccttaggtagaaattaataattgaagaagcagccctgtgtttaaaaacagttagtgtcagatgtcacgcaatggaatgtgaccaatcccctaatgagatgacccaaactgtccataattttccagagatagacttaattctcacacttgcttgcaatgttcatctgtgttcttatacttaaagaacatttaatatgttctagaatattatgttctacttcaagaactatgccaaaaattccaactggatttttcactaaaccctaaattacttgtctactttgaatttgctaaattgtgcattgtatttttttttactctgtgtttctaattgctgatgaattaatattcacatttttgcccccactcccatttttcacatttttaaatgtaatagccttatctgatatcaaatacctctactgattcaacctaagtactaattgcacatttttacagatttattataactgtatggactcttctagcttagtagtttatgtgttgctggattttattgtatcccttctttgtctgatacagtctagttctgcaccatcagctggtttgtatataatatttgcaattcctttctttgtggctggatgctctattcccagggcttgggatctggacatacaatagaatttaaatgatcctcttccaaaccccactttggtagttgaattcccatattcagctctgggaataagccagggcacttagctatgtggttatgtatgagatatacattccgtttttttgctcaataaattttcacatcagttgctctggtacctgcaaattgccttagcatgtactttaaactcttgcacaatctccctttccttgcctgagctgatgtatattgatttatttatcacttccttaacttcattttataatctttttagctctcccaaatgcctctttctcaaatttgattacttcttgtttttcttatttatctattttggtccattttattcagggtattttccttactagttgagccttccgattcttgggcaagattagttgccctttaataattgccatttttgggattttgtatagttattgattacatatatttaatttcatatactttgagtcagcttccaacgtttgttttctttaaactgtttacccattaaatgttaccttagtgataattgattgtagtcagtatttcagctggtccgctgtatatttctaatctgtcattcacgttactactgaataagttggatgctgttccatttttaccatttcatgttaagaaacaatattttccccacacccacaaattactcactaatttttatttttaccactagacatattatctctgatattttggttcataggaatacactgatacatttactcacttcattaaaatgttcctcattgtctatgtttttctttgtgtgtgtttatatttgtttatatataaggaaaggctatctcactatttgttctaacacaggagttccaaaacttggttatgtatcagaatcacatgaggagctttgaaaaatacagattccctaggatttacttcgaacttgcagatttgaatttcctgataaaggtcccaagaacctatatttgaataagcctccactgagaatctttggcaagtcagtcttctgataggcatttggaaaccaatactaaatatttctccatttgaaattgacccaagtcccacagacaggttgtgagtttttctttttgttttaataaacatagaaattgacccttctggtcttaaagcttgaaactcaccaggtccagacaatgagataccaggcccctcaaaaggtattgaagaactgaaactcaccagattatcacatccagacaatgagacatcaggccccttattcatcatgattgcctccttactcctcccttgttcctgttttcccacacatagttacatttcttccctgctataaaacccctaattttagtcagagagttggatttgagactgacctcccatctccttggctgtggcaccagatggaagccttcttcctcggcagtaactgctgtctcagtaattggctttctgtgtggcgagcagcaggacccagaccgaacccctggtgtttagttaacacattcgggactaattgtgtttaaatacttggggtaaatgaaataatacagatgacaaagctacatatatttatgaggagctctattttgatcatctatttggttttcagtctggtgtctaggacttcttcgagggctggaacttacttcagcttgttcacccatgaattccctagaccttgactccttcctgacacatgggagtgcgccatccatgtttgctaaatatagagactgtctgacccattatcaatgggcatggcttcatgagtgtctatcaggacatgtttgaaggcagttctttgaaaaataatatatcattaaaagaaagaaacacctctctggagaagcaggagggagtagggagaaaacatgagcgaggaaatgggtagaaaaacaggcaaatgttggaagcatgcagaaaatgattttgaaagcatcaaaagttgacgtataacagccacctttcttttaaggtcatttatagaaaatatctcagtgtattgaatgtttcactgttacaacaggatagtgttactcctggtcatatcgtttagtctgttgcccacaaaaatggaattttgaaataaaaacagacatccttcagaagaatttttaattttattttctgtttcctgagagagaaacaaagtaatagaagatacattgcagaaaaaaaaaaccacattgtaacataagaaaatttattttcctagtttctacagcgataaatgaagatttgtgtatgtgtgtgtgtttatttcttcaacttcatgttcttcctaggcagatcaaaggcaatcttttcaagatttgtatattttagcatgaaattagtgcatagactctgatttatcaggaaacatttatttctaatcactgaataacaacaaatgaataactaagaactctcattagaacactgactgaaaatgagttaatctatcccaatttcagagttttagtatctttcattccaaccttagctacagtttgcactctggtgtcatatgtgtgctgcacagggtttcttaaagctacagagaaatcactgcaagaaagctgtgcttcctagctgcatctttataaacagttattatcttacccagaagtgggccagatagtaaaattgcaaaacagggtgtattagtccattttcatactgctatgaagaaatacccgagattgggtaattcatcaagaaaaagaggtttaacagacgcatagtccacatgcctggggaggcctcacaatcatggtggaaggtgaaggaggagcaaaggcacgtcctacatgatggcaggcaagagagtgtgtgcaggggaactgccctttataaaaccatcaggtctcatgagacttattcactatcatgagaacatgggaaaaacctgccccagtgattcagttacctctcactgggtcccacccacaacacgtgaagattatgggcgctataattcaatatgagatttgggtggggacacagacaaactatatcacaggggaggtgtaatcaagaggttctcccacccattgttaaacttccttattattaaacttgtaaccagtgaaatgtgagcagatgtgatatatatgctactggtaggagctttaagaatgtgtgtggcttgcggccaggcgtggtggcccacgcctgtaatcccagcactttgggaggccaaggtgggcagatcatgaggtcaggagtttgagacaagtctggccacaatagtgaaaccccgtctctactaaaagtacaaaaaaattagctgggtgtggtggtgtgcgcctataatcccagctactagggaggctgaggcaggagaattgcttgaacctgggagacagaggttgcagtgagtcgagattgtgccattgccctccagcctggtcgacagtgtgagactctgtctcaaaaaaaaaaaaaaaaaaagaatgtgtgtggtttgctattttttctccctctgctggaatgatcagcaatgttgtagagagtggctactctgccaactgggatccaggaatgaggaagatgtggaattttgatccagccaacctgtaataaatgtgaagtaagagaaagtaataaacgattctttaaacctgctgagacttggggcctgttggttgctgcctcacttcttagatcattctgatgaatacaagaggtatataataattgggcaattcactagttgataatgcagaatgtttcaatgggtttatagttattcatggatatagattttacccaaggtttaatatttatggaaaaatttacataatatcaacatttaaaaaagaaaggtaatattaaaacatatttaataactacaaaatatagaattattgaaaattaaattcaaggacccataaatgtacacaattatatgtcaattaaaaataatatctctttaaatttaaaaaaagcctatttctgtcagttcatcaaacttattctccatccagttttgttcccttgctggtgaggagttgtgatcctttgagggagaagaggtgttctgttttttggaattttcagcctttttgcactggtttttcctcatcttcgtggattgatttacctttggtctttgatgttggtgacctttggatggggtttttgtgtggacgtccttttgttgatgatgctattactttctgaggtgtctgtcgatcccttctgggaggtgtctccctagtcaggaggcacgggcatcagacacccactttgggaggctgtctgtcccttagcagagctcaagcgctgtgctgggagatctgctgctctcttcagagccagcaggcaggaacatttaagtctgctgaagctgcgaccacagccaccccttcccctgggtactctgtcccagggagatgagagttttatctgtaagtccctgactggggctgctgcctttctttcagacatgccctgcccagagaggaggaatctagagaggcagtctggccacagtggctttgccaagctgtggtgggctctgcccagtccgaactttccagaggctttgtttacactgtgaggggaaaaacgcctactcaagcgtcagtaattgtggacgcctctcccccaccaagatggagtgtcccaggtcaacttcaggctgctgtgctgccagtgggaatttcaagccagtagatcttagtttgctgggctccatgggggtgggatccactgagctagaccacttggctccctggctttagcccccttttcaggggagtgaacggttccgtctccctggcattccaggcaccactggggtacaaaaaagaaaaaaaaaaaacctcctgcagctagctcagggtctgcccaaatggctgcccagttctgtgcttgaaacccagggctgtggtggtgtaggcacctgaggaaatctcctggtctgcgggttgcgaagactgtggaaaaagtgtagtatctgggccggaatgcccatgatacctagccatggcttcccttggctaggggagggaattcaccaaccccttgagcttcccgggtgaggcagtgccacatcctgctttggctcaccctctgtgggctgcacccactgtctaaccagtcccaatgagaggagccaggtacctcagttggaaatgcagaaatcacccaccttctgcgttgatctcgctgggagctgcagaccagagctgttcctatttggcaaatcaaaaccacaatgagataccatctcacgccagccagttagaatgtcgatcattaggctgggtgcagtggctcacacctgtaatctcagcactttgggaggctgaggcaggaggattacgaggtcaggagattgagaccatcctggctaacacagtgaaaccctgtctctataaaaatacaaaaaagtagccgggcatggtggcggacgcctgtagtcccagctactcaggctgaagcaggagaatggcgtgaacccgggaggcagagcttgcagtgagccgaggtcacaccattgcattccagcctgggcgacggagactccatctcaaaaaaaaaaaaaaaaagcaatcattaaaaagtcaggaaacaacagatactagagaggatgtggagaaacaaaaatgcttttacactgttggtaggagtgtaaattagttcaaccattgtggaagacagtgtggtgattcctcagggatctagaaccagaaataccatttgacccagcaatcctattactgggtatatacccaaaggattaaaaatcattctactataaagacacatgcacatgtatgtttattgcagcactattcacaatagcaaagacttggaaccaacccaaacacccatcaaggataggctggataaagaaaatgtggcacatatacaccattgaatactatgcagccataaaaacctatgagttcatgccctttgcagggacatgaatgaagctggaaaccatcattctcagcaaactaacacaggaacagaaaaccaaacacctcatgttctcactcataagtgggagttgaaaaatgagaacacatggacagagggaggggaacatcacacaccagggcctgtcagggagtggggtgttagaggagggatagcattaggagaaatacctaatgtagatgacaggttgatgggtgcagcaaaccactatggcacttgtatacctatgtaacaaacctgcacattctgtacatgtatcccaggatattttattaaagtagaataaaaaataaaaaaattaataaattatttaaaaaaataaattaaggagatcttagagttctgtaatctattttactgtcccatgtacatagaaacatccataagtctttgtggatatttggtagctatataactcatggtctttctgagtcagcaaattctattgttgaaaattatgattgttaggtagaactttcttaaatttagaggaaattattttcttgacggttaagctctgtcctaataggaaattgttttctgtgtcagccagttctactgctggacagctataataattaggtaggatttatatatatatataatatatattacatatatatttatcaaagtctttttttatttaatttttgcaaggcctacactcaagaaaaggttagattaaatgtattccactgttcacgtgacaattcttgaaatatttgaagacagctgtcatgtcccctgagtctactatctagccctaaatatggtttctcaaccattcattataggaaacctttatgacaccatttgaagaaattgattgctctcctctagataccttaatgtataaatgcctttttaaaggtacaacaagaaggacgtttggcatgccagatggggtacaacggtttctgagtatatgaggattattcttcctgggtgttatacttctgttaccacagcctgggactgcattagtttttttagagattgaatcaagcaactggatcctctaaactccctaggatgtttttctccttcctctgtccttttcttttgtgataggtttctgggaaacaacagaagagctttatttgtaataccatatacattgttaaagtaaatattacttaattttaattccatagagttacaacttaaacatttaagtttgtgtgtgtttataaacataattgataagtgaaatattttccccttagtttattagattctttgggattacctattgctataattttctaactgtgcagtataatctttgatacacttgtttcaagtatatcaatgttaaaaatattggctgggcatggatggctcatgcctttaatcccagcactttgggaggcagatatagacagatcatttgagcccaagagtttgagcaagaccagcctgggcaacatggtgaaaccctgtctctacaaaaaataaaaaaattagccaggtgtggtgatgtgtgcctttagtcccagctacatgggaggctaaggtgggaagatcacttgagtctgggcagtcgaggctgcagtgagcccatgatcacaccactgcactccagcctgggtgacagagtgagaccctgtctcaagaaaaaaaaaaaattaaatatatcattggtaaatttttatgtgaattattaatttataggctttttccattccattcatgttacttctaagataatctgctcgcataacgaccatttaaaaaatttaaacatcaatagtaaaatgaataataaataaaaattatactaaagaccgtatgaggtacacaaccaggcaaaaataagccatgatgtttgacattaggatagtggttatccttgggcttcagtggattgtaatagaagtggggatggggactggttataggatgtggattatttgtttcttggtctggaaattagatatatgattgatgaaaagtcatcttgtgtccagaatttattccttctggtgggttcttggtctcgctgacttcaagaacgaagccacggacccgcacgatgagtgttacagctcttaaagatggtgtgtgcagagtttgtaccttcagatgttcagatgtgtctggagttccttctggtgagttcatggtcttgctgacttcaggagtgaagctgcagaccttcgcagtgagtgttacagctcttaaaggtggcacgtctggagttgtttgttcctcccagtgggttcgtggtctcgctgacttcaggaatgaagccgcagaccctcatggtgagtgttacagctcataaatgtagtgtaaaccctaagagtgagcagcagcaagatttactatgaagaacaaaagaacaaggccgggcgcggtggctcacgcctgtaatcccagcactttgggaggccgaggcaggcggatcacgaggtcaggagatcgagaccatcctggctaacacggtgaaaccccatctctactgaaaatataaaaaattagccgggcgtggtggcgggcacctgtaatcccagctacttgggaggctgaggcaggagaatggcgtgaacccgggaggcggagcttgcagtgagcagagatcgcgccactgcactccagcctgggcgaaagagtgagactctgtctcaaaaaaaaaaaaaaaaaaaaaaaggaacaaagcttccacagcatagaagggtaccggagcaggttgccactgctggcttgggtgcccagcttttattcccttatttggccccgcccacgtcccactgactggtccattttacagagcgctgattggtgcatttttacagagtgctgattggtgcgtttacaaacctttagctagacacagagtgctgattggtgtgtttttacagagtactgattggtgtgtttacaaacctttagctagacacagggtgctgattggtgcatttttacagagtgctgattggtgcatttacaaacctttagctagacacagagcactcattggtgcgtttttacagagtgctgattggtgcgtttacaaacctttagctagacacagagcactcattggtgcgtttttacagagtgctgattggtgtgtttacaaacctttagctagacacagagcactgattggtgcgtttttacagagtgctaattggtgcatttacaaacctttagctagacacagcgctgattggtgagtttttacagagtgctgattggtacatttacaatcctttagctagacacagagcgctgattggtgcgtttttacagagtgctgattggtgcatttacaatcctttagctagacacagagtgctgattggtgtgtttttacagagtgctgtttggtgcatttacaattctctagctagacagaaaagttctccaactccccagtcgacccaggaagtccagttggcgtcacctctctgtctgtgtacttacaatgggtacttgtttctctacgtatcttatatttcaatagaaacttttcaaagatgtttccataatgggaactataatcacattctctaaactgttgaatgaattcggtaagctgttataaaggcaaagcctatgttcagacttccatccgggagaagtgttacttcattcacaatgctgtccttactgtgattatatttcagagaagcacaatggaattactacaattttgcaataactaaaatattgcacctataaaaagggaagctttgtcccttccacagggctcttcgaatgtggtgatgccatgtggaagctggggcttttggaagttggttatgattgagtggtgagatctcttcactctccctctcactacttcttcattctagaaagagtagtaaatacttatttttctaactgactaaagactcttatatttatttgttctattgatggtagaccttgcgtgatgctttcctatatctctattgaaatcttctgaaagtgacagaatgttcccattaaaaacaatttactgccactttgcttcaagacactggaccaaactataattaatagtgagttagagagaatggagttagtaggtactggtgactagaggtggaaagatcaacaaagagaaggaatgagatactacaatagaagaagcagacaagggccattgaaatagaaaaaaagtagagaggaaaaagaactgagaaatgagaaacaaagggacagaaagataaaaaagagagacaaaatgggctggtcgcagtggctcaagcctgtaatcccagcactttgggaggctgaggtgggtggatcacgaagttaggagttcgagaccagcctggccaacatggtgaaaccccgtctctactaaagacacacacacacactaaagacacacacacacacacacacacacacacacattagctgggcatggtggtgcgcatctgtaatcccagctactcgggaagctgagtcaggagaatcacttgaacccaggaggcggaggttgcagtgagccgagatttcaccactgcactccatcctgggcaatagagtgaaaaaaaaaaaaaaaaaaggacagacaaagatttaaacagtgatcactgttcctcatccttcccctccccaccccatcctaattctgccatagcctctctttcctacccacttcgtctgaaacttgttggcctggtcctgtagacaacttccccaccttccctcactcaggaaatccttcttttcttttttccttattactgtaattcttgtaatgaacatttgttgagggccacatactctggttggctctgaggatagcggggaaatacagcacaaggtcctgccccttggatgcattctcttgtgctatgtctttctgtggctacggtcacccttactgagaaggtgtgattgggatcctattccttgatggattactctcaggatgattcagttgtatcaggcagtattacttactcaaattataaggttctacagttaaaccccatattttacaattctgcatgtgtttgaaagtttaattctgcacatatctaaacatacatagctagatagatatagatcgagtttggctttagtttgcagttatactattttatattattatatcattatatttggttcagggcttgcaattgttttcattcagtctcttgttctatgttataaaggccaggccaggtgtggtggctcacacctgtaatcccagcactttgggaggccgaggagagtggctcacctaaggtcaggagttcgaggccagcctgaccaacatggtgaagccccgtctctactaaaaatacaaaaattagccagtgtggtggcacatgcctgtaatcccagctactcgggaggctgaggcaggagaatcgcttgaagcaggaggtgaaggttgcagtgagctgagatctcaccactgcactccagcctgggcaacagagtgagactgtcaaaaaaaaaaaaaaggtccaggtcatagagaaacaaatgtttcttaagtgcctactttatgtcagtggctttcctggataagtaagattggataaataagacatacagtatttatgtttcagaaagaaattaaaaaagaaaaacaaccaaaaccctgtatcccagataactaattcaggaatcattggttgaggagacctgatggatcttagtttagccttttaaatgttaaaatgttcagcttttctcacatgtgacatttgctggtctagatagccttaattttacagccgccaaaatttctttggtatggcaaatgcagacagaagactaatcttgtgggattaagtagagttaaaaactatttacaaataaattttagagtgtgaataaatggacagacattactatgtgtctcacatagcaatggcacatgcgcccacagtgcagtagtagatttcccctggtaccccggcatcagcactagtttacttttaagagcagggctgagctctttgggagcacattactacttcttaagtgttttttctgctatctcaggatatcccgcatgatattctgactactttagaggcctgggcaactacgctccattcatcatcagtgtgaaagaaatctacacattacatacggttaaggatatttctttgttcctttttgtgttgcaatttaaatcagagccaatgtggtgtattttagctgcgttttaggtatgtaaaattttcagtactatggttgctgcaaatgtaattgtggtttttgccattgcttttagtggcaaaaaccacaattacttttgcaccaaccaaatactaaaataaacttttttcattatataaatttgataccatgatatagacttaagaaatcaaaccttaaaaatatctagttcaaatggcatactattatagtaaatgatgtaataattttaagcaattaaacattatcacttaaccatattctcctacatgattggcattttaatgcaagtagtgtcagttaaagagaaaagttcttttgataaaagctctattgatataataactaaagtcaaagttaattctaaatagtaaataaatcgatcaatgcacatttattgggggtaattctgtgttttctgcacaattccagagttgcggaagataacataattccctttcgaaagcagaaagaaaaatacaagggaatttctaattaaatgattgattatatggcataagtgtatttgctatagaagttaagaagagagctatgaaagcgggaatgaaaatttgaactagcaaggttagatcagatttaaatgactggaagaaagtaggaaagatatttttggcaaacctaaaagctgggattgaatgtgtgaggctctgaggtgaggccactctgtgagtacagctgtcagtgtatgttgaagtgaagcaggataggggctaatgtggagaatagggctaagttataaagagacctgaaggccatgaaaacaaacagaggtaggctgggcgtggtggctcatgcctgtaatcccagcactttgggaggccgaggcaggcagatcacctgaggtcaggagttcaagacctgcctgaccaacatggtgaaaccccatctctactaaaaatacaaaaattagctgggcgtggtggcgggcatctgtaatcccagctactcaggaggctgaggcaggagaaacacttgaacctaggaggcggaggttgcagtgagctgacatcctgccattgcattctagcctgggtgacagagcgagactctgtctcaaaaaaaaaaaaaaaagaaaacaaacagaagtaagaacaggtagagatgggcagggaaacaaaacatttcttggttgtattgtacaaattataatcggtaacattcattattagcttaattattagccgaatattgtgctaagaatttcacataaattacataatcctcatatcaaccttgtaagttggtataatgattgttattttaaagatgagaaaactgagacacacagagaataagtcactaggcgattatacacaggtagtatatggaagaatcaagatttaaagtcaggcaatttagcttccaaatttctatactgagatactttaccatccaacatcgcgaggaggctctcggcctaaaaagttacacaaccctatgaaagaggtattattatcctaattttcgagttgatatactgagtgtccacaaattactactatggcagttaaaatggaaatttctacttacctgaaagcacaatacagcatttactctgagttcaattgcaataaaaggaaaatatttaatcaataatttaatcagtatatagagacagcaatactgtgtgccaaacaccgttggtggtactaaagatataacttggggactttgtaattaactaaatattttgttatacttatttcttcatttatctatatgcattttatatgctcagctactaatattttctttttttcattatttattatactttaagttctgggatacatgtgcagaatgtgcgggtttgttacataggtatacatgtgccgtggtggtttgctgcacctatcaacctgtcatctaggttttaagcctcgcatgcattaggtattaggtatttgtcctaatgctattcctcccctagccccccaccccctgacaggccccagtgtgtgatgttcccctccctgagtccatgtgttctcattgttcaactcctacttatgattgggaacatgtggtgtttggttttctgttcctctgttagtttgctgagaatgatggtttccagcttcatccacgtccctccaaaggacatgaactcatgcttttttatggctgcatagtattccatggtgtatatgtgccacattttctttatccagtctatcattgatgagcatttgggttggttctatgtctttgctattgtgaatagtgctgcaataaacatacatgtgcatgtgtctttatagtagaatgatttataatcctttgggtatatacccagtaatgggattgctggatcaaatggtatttctggttctagatccttgaggaattttcttctgtcaacatttactttggtttattctgaatttcagcctaaccattccctacccttatgctttgaagacaagacaggaaacaggtaccaacaagcacaataccagtgatgaaaatcacagttgtaagtttcctctggtgtggagccacctagtgaaagtaaaagcagattgttaaatatttcagaagtttgatggctgattgttatagtttatagtttatatgttatagtttatagattgttatatagcttgaaattagccatcacagggtgcatctacatcacagaaattggcaaacattactgacagtatgattgatatatatatatatatatatgctattaaatgtgtatatatgtaaaatgtgatatatatgctattaaatttgtatatatatgctattaaatgtgtatattatatatgtgtgtgtatatatgtgctattaaatgtgtatattatatatgtgtgtgtgtgtgtgtgtgtgtgtgtgtgtgtgtgtgtatctgttctattttcagtggctcgctgcacagaactgccagggaagaagactttttatttgggtgaagtcaaccagagggatgagagccaaacctcaaatccatctctccaaattgattaaaattggtgtgttgacatagtgggggggaaatataactacatgtgggaaacaggaattagaggaattagggaagggtgaggaagcaatcacgattgatgggggctctggcttctccttgtctgggtgccaggatctggtgagtcccttgcctgaggtttggtttcctgaggaaggaacccagaggagacaaatgttaagtttcaagtttcaagatcaggaggatcaatctctatgtttattgaaaaaaccccataaatatcagttctatgggaaaattgggccagttttatataaatatgtgtaatatgtgtacgtataattttgaagtgctttagtaacatagttgctttgttcatttattgattccataaatactgaatatgtatacatattgtaaatatgtcatctgtatacacacaggggcacacacacatataggttttcatccattgttcctggctcataactcccgtagcctttgtaacagtttttataatgctgtggctctttaggtctcaaaaaacagaaactctctctctgaccttctcctattctcctgtcagcagcccgagacaggactctaatcttctttcaccattctgattgtgggttataagatcctcatttcagaaggggtcctggcccttagcctggaaaaaggaatacagcacagagaagccaaaaagaatctggacaagccttgctgggtttctgttcagcctattagtgttagagaataccctttttgtccaatcatacttctccctggtggtcaattctgtctatgcagtgaagtctccattaaaggcccaagaggacagggtgcaagagaacttctggatagctgaatatgtggaagctgagaggaaggtgaacaagaattcatctatgtgctgggaagtggtgcaccccaactccaaagggacagaagctcctgtgcttgagacccttccagaccttgccttgtgtatctcttcatctggcggtttatgtgtatcctctaaaatatcctttggcataaactgctaaacatcataaatgttttcttgagttctatgagccgctctagaaaattaattgaacccaaagagggggctctgagagtcccaatttgaagccagtgcattagaaattctagaggctggggtatgctgatgggaaggagggggtggttttgtgtgactgagcccccaacttgtgggatctgaggctgtctccagatagtggctgaattgaattgaattggagggcacccagctggtgtctgctgcagagctgattgcttgcttagtgtgtggggagaaaccccacacatttggtcacagaagtcttctgtgttgcttgtggtgatagaacagaggaaaaacagtttgagtttttccactatcacaagtacaaatgagggcttttttttttttttcagtctagctgccagtacaccactgccctcctcctttgtgagatctttgtaggttctattctcattctttcagatgcctggtatatttgtaatttgcatcctgttatttgtatctttttttcctatcaaagagagctcacaagaatggagaaggggaagggaattaatatttcctaagcatctgctgtatatcaattactgtgcttaactgtacatattatttgatattcatgataactcagtgagttaattattactcccattttcaggctagaaaactgtgacttagaaaggttaagttacatttctgtggtcaaacatataagaactgaagttgagggcgggcacagtggctcacacctgtaatcccagcactttgagaggccgaggtgggcagatcaggaggtcagcagaccaagaccatcctggccaacatggtgaaatcccatctctattaaaaatacaaaatttagctgggtagggtggcacgtgcctgtaatcccagctactcgggaggtgccactgcactccagcctgggcaacagagcgagagtccttctcaaaataaaaaaaagaactgaagttgaatttcttatatgtgacttcaaagtccacagtctttccagctggtgaatgtgtcagtaatttaggcttctgggtttgtttagagtggctaattttgaaatgctttagtaactgttttacatagttgctttgttcatttattgattacataagtactcaagagatatggccgggtgcggtggctcatgcctataatcccagcactttgggaggccaaggcaggctgattatgaggtcaggagattgagaccatcctggctaacatggtgaaaccccgtcgctactaaaaatacaaaaaaaatagccgggcatggtggcgggcacctgtagtcccagctactcgagaggctgagtcaggagaatggcgtgaacccgggaggcagagcttgcagtgagccgagatcgcgccactgcactccagcctgggcgacagagcaagactccgtctcaaaaaaataaataaatgaaaaaaaagaaataactgggtccccatctgacaatgagaagcacatttaatgccttaaggtaggaatgaaagaggcagacacctgaacagagagagcgggtgtgtggaaggcattgtttcctaatcacaagcatttgaaaaaggctttttggggaagcaaatataggcctcttgacgtccaagaaatcctactgcattcctattccagttaaggctgagcctggaaacaatgtttagtacctgttctcttaaagacctttcataccacttcagctgtaagttaataatggagtctttgtataataaaagagtaaaaatagacttgtttttctattacattttgtttttggttagggaggaaaaaaacgtgaagctgtatcaaggttgtatttgtcctaataaattttgctttagattcattgacgttcaaaggcacaagtctcctaaatctcagctctgctatttgttacctacttattacattgcacctgttgataactagctcagctttttggccccacttttctcatctatagtttcactactgtatgaatactcaccttacaaggctgtctggctatagataatgtacatagtctctccaatctacttttgtacccaacttctatcactttcctgtggaatccttaatgttagtaaaacttttctcctcactacgctttgatcagtcctttgggattaactttcctgaaatgcctccttttctctttgtcccttcagtctccaacccgaaggcccaagtcaagtttagtaccctcccaaatccttcccagtccatgatatctgctttagatctcttctattctcttctgagtttagacttggtcttcctttcctttacctatttgtaattataaaccatcattagcatctcttgtagcattgctttgtgcggttacacatatctttcccttttctttccaacaagattttaattacctagaggttggggttgttatgtttcttcacatttctcatagagtgcaacacacctgaacagtctcaaacagcagcaacattaatatgtactaacattcataatccttccatgagcattgcatacagaactgtgcacagggtgaatgtttaataagtattgcagtaattacttattacttctgtgttaattgtagtatgttccgaggatccaacctctgcagcacttttgctcagtttcttgacctgcataaattcccaagaaaattaacaaaaagtttgttatggtctgaactatgtccttcccaagttgataggttgaaatcctaacccccagtatctcagaatgtgactgtattttgagatagggtatttgaggaggtaataaaggttaagtgaagtcattagtgtgggactggtgtccttataagaagaggaggttagaagacaggcacatacagagaaaggaccatataaagatacagggaaaagacacctatgtacaagccaaggagggaggccatagaaaccaaccctacaggctgggcgcggtggctcacgcctgtaatcccagcactttgggaggccgaggcgggcggatcacaaggtcaggagatcgagaccatcttggctaacacggtgaaaccccgtctctactaaaaatacaaaaaattagccgggcgtggtggcgggcgcctgtagtcccagctactcgggaggctgaggcaggagaatggcgtgaacctgggaggcggagcttgcagtgagccgagattgtgccactgcaatccggcctgggctaaacagcgggactccgtctcaaaaaaaaaaaaaaaaaaaaaaaagaaaccaaccctacagacaccttgatcttgaacttcgatcctctagaattgtgacaaaataaatttgctgtttaagtcactcagtctgcgtgtgtgtgtgtgtgtgtgtgtgtgtgtgtgtgtgtgtgtgtgtgtgttttcagtctggcaaactaatacatcatcttagaagagcaagtttgtctgcatcttttcattgtacagcctgcttccctttggatctggccctttcatttaggttctgggaggagccaatgagttcaactgcttagtagtttgttttgttttgttttgtttttttgagacagagtctcgctctgtcacccaggctggagtacagtggtgtgatcttggctcaccacaagctccacctcccaggttcacgccattctcctgcctcagcctcccgagtagctgggactacaggcgcctgccaccacaccccgccaatttttttgtatttttagtagagacggggtttcaccgtgttagccaggatggtcttgatctcctgacctcgtgatccatccaccttggcctcccaaagtgctgagattacaggcatgagccaccatgcccggccttagtggtctttttgagagagcacagagaggcaggagaccatggtgggtatgaatggattgctctgcagtcagacttttttgactttgaacatcagtttaatcacctgttagttgtatattcttgggcagattaatagatttcttgtttttgttttgcttttttttttgattcggagtttcactcttgtcacccaggctggagtgtgatggcgcgatcttggcttactgcaacctctgcctcccgggttcaagtgattctactgcctcagcctcccaagtagctggtattacagtcacgagacaccatgcctggctaatttttgtatttttagtagatacagggttttgccatgttggccaggctggtctcgaactcctgacctcagatgatctgcctgcctctgcctcccaaagtgctgggattacaggtgtgagccaccacgccctgccttaaatttcttttttccttggtttcttcacctgagaaatgaggcccataatcacatatttcttataaggatgtgagaatcaaattagtttaaacatactagtgcttagaacagttcttagtacatagtaattagtaaattctagctattatgtaaagatttttacctttattatatgaagtcatttatttttgatgaattgaattcttaacagcctaattaaatggtttagcactgaaattgagagacccattccttctaacacatattcctgtaaccacttgtattcttaaacaggtttaaaacaaagagctaaattatttatttctctgttgtgtgtgtacatgtacagacatatgtacatattcatctttattaacccaagaagaagtgatctgttagcacctctctcgtcacaggaaaaacacacatttctgttgtcaagtttccctggctcccaggcctcctttgtttgggtacctcagtcactgggtcttgatcctgttgaactaatgaggcaaattgactatgtagttcagtgttgatgaatggtctaagaggtgacttcaattgaatatttttctttttattatcatgtttttcttctaaattagtgctataaaaccaaggacacactttcactggtgtttctgtgatttgagattacttctgttactgcctttagattttgtttcccaagggggttgcagaacggactgcttttgcacattgtgagcatctaatcagttacaatatgctaataagttttaatatggtgtgatcttgtgtttataagcacaaaccttattgtaaatgtcaaaataattcagatcttaatatatcccctgtagtgatacattaataagggccataggagcaagtactgtaggtggttaattcttaatggacaaggatctttttgctatttgatttggagatcaaaacccagagagacaataaatagcctgcattttaatttcagaatgtgatatttgctctcctcacagcaagggagaagttcccttgaaaatcctcatttgttaatacaccatgacagtaccaaggacatgatagggttttctacccatgattgtcaaataaataaatagatgtattcatcattgtgttacaattatatgtagtcgcaaaagtagtctttgagctcaatagcatagcaccactactttttctgttaagaaaacggaggtcatagaggttaagtgactttggatcatggacaaatcagatctagaacccaattcattgattccaaatccaattttaattttggagctttttattttatttttaattttaattttttttttttgagactgagtcttgccctgttgctcatgctggagttcaatggcccaatctcgcctcactgcaatctctgcctcccagttcaagcaattctcgtgcctcagcctcctgagctgggattacaagcacacaccaccatgtccagctaatttttgtatttttagtagagacggggtttcaccatgttggccagactggtcacaaactaattttggaacattttatactacaccatctgtaataaagatttgaaggaagcaggataattgttagattttaattgcctttgacattgaaaacatatttttttgagaaaaatagggagaatacacaatgtgactagttatttttggtattcattccataagaagacctttctagttgctgcatatatttgttagcattatgcatgcaaatcactactcactatttttgtacttcttcatgaattgacttccacaagatagttgatcactaactttaatccaaatggagcttaagacaaaatacaacttagcgtaatgtcctacaggttcatccgtgttgttgcaaatgacagaatttatttcttttttagaggctgaatagtactccattgtgtatatgtaccatgctatctttatccattcatccatcaatggacacttaggtcattccatatcttgactattgtgaataaagccgcaatgaacacgagaatgcaactgtctattctacgtactaatttcaattgctttggatatatacccagaaatggaactgacagataatatggtagtcctatttttattttgcaaggaacctcgatatcgttttccataatggctgcactaatttatattcccattagcaatgtataagagtttcctttttgtgatgaatatgttaagtagtttgatttaatcattccacattgtatacctttatcaaaaaatcaccttgtactccataaatgtatacaactatgatttgtcagtgaaaaataatatgaaattaagaaacaacattaaaaacccaaaacacaatttagctgacaatcactcccaatgtgacaaaatttaacaaatcggtattttatgttgccaccaggaggcagcacaaccaagcaatccaatctgttttcattatcatttgttttttcaatctggaaaactgaatagtgtacaggcaagtatagtattgaattggtcgatataacttcttattacatcatctcactatcttttgccatgtaggtttaaactatgacttagtggtgcaagagaccacatcttcaagtagcaaatgatggaatctcaatgaccacatccatgatctcctggtccaaaaagcatatgttctgtttctatgtatctccatttatctaggtcattcaactaattcctgggggtaggggagaatctcctttcaggtggcattatggtttagaggacatatgaattaggcatgagaagtcctggcttctccatgaactgtgagatcttgggatcttggcctcaatctaaccctcttggcctcaacattctaatatgcaaaatgggagagatgtgtgaaggtaacttttccttttatgatatctttatgaggtaatatactatgcttctaaaaaagaattggcaagaaaaaaatgtgagaattccttcagccgcaagactgacaggaaatctccaggtttccctgtagtctaactcgtatcagaagagtaatggctgagtcaaaatacatcagttcaaaaatatggcactgtttcttaagcctggaatgatccaaccagaatacaaactcggtgtttgtacctcacagtgggttttaacatctctagaatgcacttcatatgtgtagactctgaggcactttgatggaagattatttctgatatttaggaaactgtcaggctgccttttggagatttgtagttgctgtgattgacaactggtttcagatatatattttcattgctttggttaggtgtgagtatatatcaaaatgaattgctgagtgtatgaaataaaagaaaagtgagtttcttctacttgtgtgatctctaaagatcttaaaggaatcatttgtaaagcaaattggctaaatatcatttatagcaacctaagggaattttctttttttatatataaaaaagacatgagaattaaaccaaaggtctttggtgtgctaaagacctttgaatgtgcactagttttggagtaagcaaactgctattgtgttttttctttattgtcagtgttttaagaccaatttattcaagccatcagatggcttctttgtacttacataaaatgaagtcatgtatgcttcaaaccaatcctctatttattatttatttgcatggagctttattcacactattattattattattttcttcaaggataattggggtgcaggaatatttaggatttggacaaaaaatttaaagacctgatatttactgactttactcaagttgatattctatctttctagcttaactcacattttgtaacattttaaaggattattttcaaaataaagaatatatacaaagttagaggaccaaacagcaaaaagttttctctttccattagggaatgctggattccattacggtaagacattttttgatgaagtaaagcagtatattcaactgtcagccaaaaggcaaaaacttctatttcttttcttgttattgatcttcttggaagcccgtatcatttgcaaaaatataattcttaactttttcacatccagtttcttttttctttttcttttttcttttttttttttttgagacggcgtcttactctgtcgcccatgctggactgcagtggcatgatctcggctcactccaagctccgccccccgggttcacaccattctcccacctcagcctcccgagttgctggaactacaggcgcccgccaccacgcccagctaatttttttttaatttttttttttatattttagtagagacggggtttcactgtgttatccagggtggtctctatctcctgacctcatgatccgcctgcctctgcctcccaaagtgctgggattacaggcgtgagccactgcacccgaccttcacatccattttctaaagtgtaaacatttttttcttcatgattatactctaaaacactgtcgaatttacaataagatctccatggacacaattactttagttttccgcaggctggccagtgaaccagatcagtgccagcagagaagcatattgtaacgctgctattgatacggaaggagagcagggaagtgctgggtagaggagggcatggtccctggttagggctccacccccagggacctaggtgaggacgggcactcctgccttcctgcccaaatgttgcatttgccaagaccaccctggcccaccacgcctccatcctgcacctataaaaactcgagaccctagcgggcagacacacaagcggctggaggtcgtgaggaacacatctgtggaggaagacacaagtggctggttgttgagagcacgccagcggaagagcacgcgacaggcaccggcaggccaggaggccattgacccgcgagacaaggcggagtttggccggggcagttggaggagagtcctggaccacggagcggcccaactccgggggaaaaccatctcccttctggctcccccatctgcagagagctacttccacttgataaaactttgtattcggccgggcacggtggctcacgcctgtaatcccagcactttgggaggccgtggcgggcggatcacttgaggtcaggagtttgagaccagcctggccaacatggcgaaaccccgtctctactaaaaatacaaaaattagccaggcaggtggcatatgcctgtaaacccagctacagctactcgggaggctaaggcaggagaatctcttgaacccaggaggcggaggttgtggtgagccgagatcgcaccattgcactccagcctgggcgaaaagagtgaaactcccctctcaaaaaaacaaacaaacaaacaaaaaaacctttgcattcagtctccaagcccacgtgtaatccgattcttcccatagaacaaggcaagaaccagggatacagaaagccctctgtccttgcaataagtcctgggtctaattgagttgactaacacaagccgcctatagacggcaaactaaaagagcaccctataacacactttctgagccttcagctgtaaacattcacccctagacactgccgtggggttggagccccacagcccacgcatctgtatgctcccacagagttttgagcagccgggcactcaagaagcgagccacaccaccatcacatgccctgcgagggggacaagggaaccgttgccgtttcactctagcagcaccacacagctctttttggggaatgaacttatggttgtaacaaagataaaaatcactgcattaaaaaaaaaaatcccaaaataccatgttaatcaaacataaagtacaaaaggcattggagtaatgttagaaacttgactggatttgcaactgacagagcatcagaaggaatgagagcacatttctctttcttcactgttaagagacttcaaacgtacactacttttagtccttttaaaatcattcagagcctcagtccagcaagattcattgtagaggcattggttccttaacagctaagctcaaaatatgttgttggtaagaaatgacattatggaacacatcgtgtttaagtatgcgacctgttgaagagtgtgtcttggttcttaatcttgagatccatagcaaatgtggatgctgatatgcaagattgagagtatatattaacccccttttccttttagtggcaagagatttaagatggaatttagatctcagaaaatacaactggtaacaggtatataaccctgagaaagaaacaatcatccctttattggagtgattctgtatgttttatttagttttcttattgcaacgctccttccaccaccgtcacagtgatttttgttggacatagcttgaaatcctccatcagaattaaagaaggaacaaacaaatcccccctcctgctatagaacaaaagcaaacaaacaaaaaaaaccctacaaccctcctgctggttccatccctctgtgggcttcctgcagcttggttcctgctgttctatccctaagccgactgcaggcagggtgaccatctgctgctaggtcacagctgcctcttcaaaattatgctctggttcctctgtcccattttaaatgcctgaatattgttatatgttgcttttatcatctcctgaaaagctgccaacacaagtctctatttggaatcattggtcttgaatattcctttaagacatatacatctcatctcttattttctagacaagtatcatacagagttctttcctaaagcaatggtcccttctctgatagaatccagactctcaagtaagtgagaattaccaatatataccacattaagtctcacactatagatattaatttttttgctaataaatgtgaatgcttatatttgatttttaaattttatgttttcagtcattgataggacatttgggcttagtgtttttgtgtaacattaagaacatgaagtcacaaatgcagctagagaagagacaaagcatgggaatttttttggggcgggtggcgggggggacggagtctagctctgtcgcccaggctggagtgcagcagcgcgatctcggctcactgcaagctctgcctcccgcgttcacgccattctcctgcctcagcctcccgagtagctgggactacaggcgcccgccaccacacccggctaattttttctattttttagtacagatggggtttcatcgtgttggccaggatggtcttaatctcctgacctcgtgatccgcccacctcggcctcccaaagtgctgggattacaggtgtgagccaccgcacccggccgggaaatttttaagagtaattaaagaacattgctgggcagatctcctgagatatgctaattcttgggtgagttaacatggttcattcataagagttctttcttctttggacagagtatctgtgggcttcaggttcctggggaacagcttttaataatgatgtttgatagtatggcctacgattgtctattttaaaatgtagcattttctcatatcataaaattcaaggacatagcactaaattttgatttgataaagccatttctatagagatctaagataagatagcctagacacattgtattccaaagatctgttttaggaatagaatactagagactcattatatttagtgtaaaacacttaggtacttctgagttttctagtgatcacactaaaaagagtacaaagaaacaggtacaatatatttcgggctgggtgtaggtggcgtgcacctgcagtcaaagctattcgggaggctgaggcaggagaattgcttgaacctgggaggcagaggttgcagtgagccaagatcgtgccactgcactccagcctggtgacagagtgagactccgtctcaaaaaaaaaaattatatatatttcatgtacccaatacatccaacatattatttcaacatataataaaaaattataaatgcaatatgttaattcttttcttggataatctagtgtgtattttacatttacagaacatctcagttgatactaataatattttaactgctcaatagctacacggatctggtggctactgaattggacaggacaattctagtggaataactggctattatgttttttgtatagccccttttaaaaactcagggcccggcacagtgactcacacctgtaatcccagcactttgggaggccaaggtgggtagatcacttgaggtcagaagtttgagaccagcctggccaacatggtgaaaccccatctctactgaaaatacaaaaattagccaggcgtggtggtgcatgcttgtaatcccagctactggggtggctgaagcaggagaatagcttgagcccaaaaaggcagaggttgtagtgagccgagattgtgccactgcactccaggctgggtgatggagtgagactgtctaaaaaacaaaaagaaaaacatacaaaaaatcagatatttccagtatgtttgactagtgctatatgacattgagatggttgaattcaaatgtaggtagcaaaatttcaactttttttacaaaagttgaaagcccagtttgtcttctcactcagataggtaatcattaacacagaaatctacatactggtaagttgtaaagtttttttactcccactttgggtgataaagatgatagttacttcaattatcttagcaattatttactttcagaggtgcaagttgggcaattcattactgctgatattgtttaggttgtcacaacttttaagatcatgtatatcctacgagacttgaaataaccttccaaagtttaggttattacctttgagaattcactatagtaggaattaactgggtgacacatttaaatcagtcaagaatcgcatttttcttatgaagttaatttgtataataacacatttaagagtaagataaacagtacaacggcatacaataaggagttaaaaataaattgctactttctatggaaagaaaagtagtaagtttaatggtgaaattccctaggaaaaccacacaacttaacatcttattcttgccaagtagcatgacctctttaaaagctctcatctcatttccaaaaggaaatagaaaatcaatgaaaacatcaacaagtaaagtaagctaggtgcttcagagaggaaatagaaaatcaataaaacacccagcaaagtaagttctatagtaacatttgtaaatgaaattaatatgtgttagagaatgtgtgtgttcgtgcaatgaacagaatcacttaatgcacactattatagaaaagttagttcctcagagagttcatgctatgatgcttttcttggtttgcatttgaagcaaagagggatagaattaacatgaatgccttatgatatatttagttagtggatccattattgtaatttaagttgtatttatactgaataatccttattttatattttacctggattgaattttgaaacaaaactggatataagatggtaaaaacctagaaatttcattttcatcagtctttctaatatacactcatgcaccgcataacggtgtttcagtcaatgatggactgcatatgtgacagaccccagattataatggatctgaaaacttcctattgcctaatgacatcataatcaatgcattactcatgtgtttgtggtgacgttggtgtaaacacacctactgtgctcccagtcatatgaaagtataacacatagaattctgtacagcacataatatttgataatcactattttactgacatgtttactatactatgcttttatcattattttagagtgtactcctacatatatgtgtatatatatataccgttaattagtataattaataacaatactaatgaacagttaattagtactaattgatactaattattattatgagtgtatatatatatactgttagcctcaggcaggtgcttcaggaggtattccagaagaaggcattgctatcatagcagatggcagctccatgcagtgggataagatgtggagctggaagatggtgatattgatgatcctgaccccgtgtaggccgaggccagtatatgtatttgtgtcttagtttttaacaaagaagtttaaaaagtaaagaaaaaaatagaaaaaaaatgtagaataaggatatagagaaactagtcaaagagttaagaaataaaatgtataaagtaataatgttacagtaagctaacattaatttattattaaagaaagaaaaattggatcccatgaatgtagtgtagcctaagtacacagtgtttctgaaggctacagtggtgtatggtaacattctaggccttcacattcactcatactcattcactgagtcactcaggtcaatttccagtcctgcaagctccattcatcctgagagccctttacaggtgtaccatttttaatcttttataccgcatttttactgtaccttttctgtgtttaggtatgtttagagatacaaatacttactattatgttctaattgcctacagcattcagtagagtaacatgctgtgcaggcttgtagcataggagcaaaaggctgtatcatttagcctaggtgtgtactaggctataccacctagatttgtgtaagtacacttttgttgtcttgatgttcacataacaactaaattgcctaatgttgcacttttcagaacattaagtgattcatcactgtatatagaaccattctgatcaaatgttacatttggatttttcttctgtgtttagtcacagtataaattttatcacattttattcacatatttaaaagacaatgccagcttttctagaagacttcatatatttatagaacaaggcttaacgtatgaataagaatctaattccttttaaatagcttttaatctatataatttataatgacttttaaattacctctagatatttttaagtggtaaagcctttggaattatgaaattgcattctaagtttaatgtagttagtgctttggtaactttgatactgtaggatgggccataaaataaatgtatcctgaaaagatttttttaattcccattttaatcaagaaaatgtgagatatgaagattatattgccattaaaataaattcaaaagcttcatttactttttaaaataaacttctcattttaggagagttttatatttatagaaaaatcataaagatagtacagagagttcacatatagcccatccccagttttccctatttatcttaaattgctatggtacatttgttacaattaatggaccgatattgatacattattttaaaagtctatattttactcatatttccttgggtttacctagtatccttttttctgtataaagattccatccaggatgcaggattatattagctctcatgtctccttaaattcctcttggatgtaacaatttcttacacttttcttgtttttaatggcctttcatagttttgaaggttatggccaggtacttcatagactgtccctcagttgtgacaaatgttcctaatgttttggggaggaaaaccaaaggtaatgtgccattttcatcacattacatcagggaaacatactatcagcagaagcaatcactgttgatgttgccattgattacctgactaagaatagtgtgtggcaattttctccaatgggaagtttctctgcctactccccctttctatactacatcctttagaaaaaaagtcattagtgcagttctcacttagggaatagggagtaatgttccacctccttgaaggtggagtgtctacataagttgcttggcattttctgaataaaagatttatcccttctctcctattgatttatttgtttcatcattttaacagtatgaattcatggacatgtatgtaatacttggggacataattctatactactttatgttattgcttgaatggtttctgctttagctgatctatccctttgacacaccacatcaccgtatgggggtgtgtgtgtgtgtgtgtatgcacatgttttaattttttttagttcttccttacttcatggcactaaaggatactgtaggcttctcttctatatttcctaccccaagcctagaatccaccatttctccaaggggtccttgttccttttgtttcaggatggtatcagaaacagacacctaggagctttatacgctcattgctgctgggtgtcattgtttctaggactcttagctgacacagcaaggaaatacacacacacgcacacacacacacacacatcatttactttttcgatccctgtttacctatgtgttttggctgcatgttagtcacagaaaggctatattaatactatcttatatttgtggactgcatgtttcaatgggttaataatgatatgctacccataatcccctctcctctccataccagcctcattttatgggtggagtcactatttgtctaatttggttttaaatagtgactttaaattttttaaccaggcagacctattaaaaatagtggtcatctgacatacaaaggaaaatgatagaggtttgtacaagttttttatcaaagcaaggaaggaaaattatcctgacttgtgaagtttaaggatggatgaagtgtttaagctcataagcaatcataaagtccatttccttgaccttgtgattattttgggtctttctataaaaaatttcattttctagctcatgttacaccatgtgcagttttgattactgcaatatggtgttactgctttaccaaaggtaaatattcatgcctcatttttccaaccatatttaagctggtctgtgaagctttgttttttgttttgttttgttttgttttgttttattattatactttaagttacagggtacatgtgcacaacatgcaggtttgttacatatgtatacatgtgccatgttggtgtgctgcacccattaactcgtcatttacattaggtatatctcctaatgctttcccttccctctcccctcaccccacgataggcccccatgtgtgatgttccccttcctgtgtccaagtgttctcattgttcatttcccacctatgagtgagaacatgcagtgtttggttttttgttcttgcaatagtttgctgagaatgatggtttccagcttcatccatgtccctccaaaggacatgaactcatcattttttatggctgcatagtattccatggtgtatatgtgccacattttcttaatccagtctatcattgttggacatatgggttggttccaagtctttgctattgtgaatagtgccgcaataaacatacgtgtgcatgtgtctgtatagcagcatgatttataatcctttgggtatatacccagtaatgggattgctgggtcaaatggtatttctagttctagatccctgaggaatcgccacactgacttccacaatggttgaactagtttacagtcccaccaacagtgtaaaagtgttcctatttctccacatcctctccagcacctgttgtttcctgactttttaatgattgccattctaactggtgtgagatggtatctcactgtggttttgatttgcatttctctgatggccagtgatgatgagtgatgatcatgtgtctgttggctgcataaatgtcttcttttgagaagtgtctgttcatatcctttgtccactttttgatggggttgtttttttcttgtaaatttgtttgagttctttgtagattctggatattagccctttgtcagatgattagattgcaaaaattatctcccattctgtaggttgcctgttcactccaatggtagtttcttttgctgtgcagaagctctttagtttaattagatccaatttgtcaatttcggcttttgttgccattgaagctttgttttttatttgactcttttaattatttaactagtattagcttttattttatgtattagcttttgctaacaaaaaaagtcaaaatctcaatgacttacctcaaacacttatttttgcccgcttgtctctatacatcttctcattctgagactcaggtgctggaggagcctccatgtggctaatgctgtgctcatggtagagaaccaggaatacaagccctgctaagcccgttgcaaccacattaagcttctgcttggatgcagaaagggcatatgtcctctcattccattggccaaagtccaaagtcaatgcgtcagacaggatcatctactcctcctgtagaagcacaggaaagttatgggaaaatcgcaaaggatgtagaaacaaactacagagagtgaatgaggaaacacaagcaagaacccagcctcagaaactttgcctaaatacttatgcattagaattacatcagctatacgtgtcagaaagaccaagagaaaatggcttaaaacaaaggagaagtttatgtctccctcacccaaatgaatggtccatgctcagtatagaccttcacaacgttcaggactgaagctctttctacgctgtttctcagctgtatgtgatggtatggtttaagatggttccaggcagtagtatggaggaagagatggtgaaacaacacatcagttgttttttcagaagggtttagaaaactgctaagtaataattttatttacattttattggccaaaacatagtcacatgattatacataaatgcaaggagacttgaaaatatggtcttattctttgtttctctgtgcccagctaaaatttttattattgtggaagatgtggagaaagagttgggaatgaaaacatgttaacagacttggagcaaagttctttgaatgaatcagataaagtctaaagaatgaaggaacataaggtaatcaacaaaagaccaaatgaaaggcagaaacaggttaaaaaattcagaaaataatggttcaattgagtggaaaatgcaatgaggtaacaacaggtaacaacagactttgagcagagaagagagatggctggaggatggaaataactttgaatttttgtaggagataggtgcaaatcaagttctcaaagagttaaaattcagtatttttctgctaacgtaacgatccatctcaggaatcttaagttaaccaacaattgccccaaacttgtttcagttcttcttatgacctttcatttagattagttttaagtaatttatttcctctggtattctaatcaaatggcttaaaaaggatctctgagattcctgaagtatgcttggctgttcaaatattttccaaacaaattaatggacttgcaaatcagacaaaagagaagttaggctgagactgcattgtgtgctctgtaaagccagagaatgaaaggatgcactgtgtaccaagacattgacttaggacagtaaatgtgaatacaccttcttatagcaacgagcaaatgttggtttaaaaatactggtagcacagccgggcgtggtggctcacggctgtaatcccagcactctgagaggccgaggcgggcggatcacgaggtcaggagatcgagaccatcctggctaacatggtgaaaccctgcctctagtaaaaatacaaaaaattagccgggcgtggttgcgggcgcctgtagtcccagctactcgggaggctgaggcaggagaatggcttgaacccgggaggcggagtttgcagtgagccaagatcgcgccactgcactccagcctggacgacagagcaaaactccgtctcaaaaaaaaaaaaaaaataataatggtagcacactagagcataacgggaattttatactgacaatttcatttacagtatttaattcaggaacatctctatgaatataggcactcgatatgtttcatacctgtgttcttatactttggtacctattcctcatcttttgtaaatggtatttaagacacatcctaatatttctgaagtattcagggatatttttaaagtgtgggtgacgtataaatcaccagctagttgtatctggtgcgttttactttgtgcttgagaatggcattgcaattctggccagtgactatagagtagtcattttctagttaattggttttaagaaagtttaatcattactggaagcacttaaacagacatcaggttagacttgacgtttatttatttattttttacgtttcaccctcttggtcttttattcttttattttaagtcttgttttattttagcatatgaagtgaatgcagaccattctagcattgtacatctgggggactaccatgacctttaagaacagcagcatcagaggaatctggggaaatatatgctttgaacatttaataacaccactgccatgacttagtgaatatttccatgcctgtgtattatgaaaatatagcactgggaccatggttgaaaagttcaaaaccacaaaagctgaagaatacatggcatttcaaatgtctgcattactgttctgtgagatgtttagttctactttgctagagccgggattatttaaacctcggtcctgtagattataacaagaacagttgaaacagcgatgatttcatatctgagatgactctataatgtaaaatgctttttaaattctcaagtttaatcaacagtgtgtgaatgtaaaggttgttataaactcatgatcagtgttttacaaataacctgaattcttttgaactagctgtgttttgacagaggttttttttttttttttttctttttttggttttttgcttctctgacaaaggcctttggaagaatgagcttcttcccccacatctttatttatttatttatttttaagctatgctcaggaaaatgaacatttctcctttgcagttgataacagcatttacaaggtatacagcatatagggttgttccaaattccttccccagataaccatgcttgccaaatagctttgactttgcaaaaacattgcattgttggacaaatgcctaacatgaatctttcccaaactttcggttggggaagcaaatatgtggaataatgctcagagccatttgctgttcaaaggatttcagatcctccatccagccccacagatactcagcctttgctacagttttagcagcatgcttggcttttttgacagcagtaatagctctttggcccactttctcttctaaactttatctaaacttcaaactctttggctttttccccctcttttgctaaagctagtgatcacatgctgaataaataatctatagaccatgatctcctgtcctgtcaggcttgttacccaaactctaaaccagcgatgtcagaaacctgcctgataagtattcccaggtagattttctaactacctcccccactggttaccatcatcattgcttacatacttccagaactccctcatagcacattgactatatttggaagaactaattggtggttctggtgtctttgttaggaaaaagtgacactttttgaagttaataaaaatctcttcagctacagccttttatcagatgtaacaaaacattgtttgaacaaatatgttctcagtagtagtgacagttcctttctgcttttcctagccatcaacatcttaggaaagaaaatggtagaagttccttaatgacataaaattagtttttgaataatggcagctcctgatagaatattgcttttcaaatcaagaactcaattaaattaggttccaattggattgcatcagcatttttatatgtctttaagtaacatatttttcatttgatcttaagcaacttttaatatctatttcaattctgtacaaacattttttactatattaacggctcttagaggaaagaagcatatttatcaaatatcacaattaagaaagtgactctgtgattattcaggtgtgacatcagcaaaactaaaaagggttccctttagcatttactaacagaattttcttgagaggcaatgagaagcagagagatcatgctctttggggacagaaagtttacctgaatacaacagagcttgatttattcagcagtgactgagaattcagtacagtctttcaatatttgaactctagtataagatgtacttgtaaaaatttctttatttcccatttgtaaatgttaaaacaaacatattcttgtttagtgtgagggaaaaggataaatataatccactaaatatagtgcaatgccgatgggtggctgggtacactcgattctccctcctccatgatatcgttatctactctcaattcaccctcattcacataatacctaattgaaatacattgataacctgaagacttaaaaaaaaaggaatttggatgctaccactgttttataaattatgattttgatatgggaaaataaaaaagtttattcatagaaatctactctgctgcttttcaggagccttatttttcttaattaaattaaattaattaattaattaatttttttgagatggagtttcactcttgttgcccaggctggagtgccatggtgtgatctcggctcactgcaacctctgcccctgggttcaagcaattctcctacctcagcttcttgagtagctgggattgcaggcatgcaccaccatgcctggctaattttttgtatttttagtagagatggggtttcaccatggtggtcaggctggtctcgaactcctgacctcaggtgatccacccgcctcggcctcctaaagtgctgggattacaagtgtgagccaccatgcctggcctatttttctttcttttaaaaatttagatacttatttttaaatgagaatagaaaatattaagtgatctagttactttgttttctttttagcctagtgaactaccaaattcagttgatttttttttgcataatcaaaagtgatacatgaaaatattaaatctaagcaggtagatgaatatttgaatgagaagttgtgccagtagtatgtacattaacccagtaaaatttataaatcagttcactaaaaaattcagctaagcataactaacttgacaattttgaatagtaagctattattagcactttttccacaagtatatcatatttccaaaatattcagcactaaaaattttaaggttaaaatgggactttatcaaattcataagtattttgaattcagatgtaaaataaattatttttattatttgaagcattcgttaattgcaccgtttactcaacaaaaatgtgttgagtttcttttttgtaccaggcactgtgtaaagtataagtgtgtaaagtattactttactttataaagtaaagataggtgagatgttcatccagccttcagtgactttacagaattaaaatgtttcttaattaaaaaaagaaaggcttaaaccaagtaaaagcccaaactaaagcaaacagaaatggacagaagacaaaattcactgaggaattagcaccaataaatacacaggtgtgttttctcacctgttttgtgggattaaactgaggcaatattttcacgaagtgtattatttagtcttaagaaaccccacgtgtttcttagttcgcataaaagctgttgaaatgggttaaataaaaagtggtgttcatttcactagagatcaatgactcaaactgacacttgtttctaatggtcagcaaattttattttcaatgtgtgtattactttttcataatcgcaaaccaaagtttgctaatcttcatcaatctcctgagtatttagtatagtagaaatgatttgttttgaaatatcagagcatatgatgatggaccttaattgtgtgctgctacaatagaataccacagactgggtaatttttaatgaacagacatttatttagcttacagttctggaggctggtaagtcccagatcaaggggcaggcatcttgtggggccttcttgctgtgtcataacatggcagaagggacgacatgtgcaagaaggaggaagagagagagagcacgcactcgcaggcacttgagagagtgagagaaggggtctgaactcatccttttataaataagccagtctctcaataatgacattaatccttttaggagggtagagccctcatgacctaatcacctcttaaaggttccatctctcaactctgttgcattgtggattaagtttacaacacatgaactttgggggactcattgaaaccacagaagtgacctatgtttaatctttgtactatgaaattttccttaaaaaattaaatctaaaaaattgtagctaataggtgaagaattatcttattatcacactgttataaattgtatttctttattgctaatgaggttcaaatagttttttgttttatttttcattaacacataatgattgtttataaaataattaaatttttaaaatactatctttaagtctttgtgttgaaactaaagaccaaaatacaaatatttaaattggaatgacctagatatataaatatgaaattgaggacttagatcctgatggattaaaatgggttggcaaatttcttctgtaaaggaccagatagtaaatattttaggctttgcaggccatatgatctctgtcccagctacctaacttttttgtagtactgagaaatcttccaccaacagtgcataaatgaatagacatggatgtgttcttttttttttttttttgagatggagtctcactctgtcacccaggctggagtgcaatggcgcgatctcagctcactgcaagctctgcctcccgggttcaagcgattctcctgcctcagccctcagcctcctgagtagctgggattacaggcacccaccaccacgccaggctaattttttgtatttttagtagagacggggtttcactgtattagccaggatggtcttgatctccagacattgtgatccacccacctcggcctcccaaggatgtgttctaataaaactttctttatacaaacaggctgggtactggatttggcctaaaggatatagtttcccaatccctggattaaaacatacattgagtggataggcatttatgttaaccacaaatgtgactgtgtctttgctgatgagtcattgcttcaaagactgagattcattaacttttgggaagacacaagctgcttgtttctcaactctattttaaggaaatagattgcacttctttctttctcataatcagatagggatcatgttgtacttactgcagctctgccaaggaatcagttttttatatcagtgcttcatccaattccttcccgccatggcatgtttggaaaagaatcatatttatattaaatacttgggcaaatggctgaggctgcttatggatgaggattttgattatgccctttaaattcaaagaattatcacagtattctcacttccttcccaattcttcttttcctctcccccacttttttttgcggcccaattctttgcaggcttgagttcctctaaatatatccccccaaaatgaaggtgacaaacacttgccaggaatgagatgagatgctgcggtacattacttttacatattttagtgaccccatctattttcatttttgtgaagaaaccaggaaaaataagagattttctaaggccttattcaggattaaatttacatatttacatatgatatctatcttttaaaatctgaaagaagtctctttttctggagtcttccttgtcctctgaacccttttccctcatgttcagttacttgtttataaaataatgtcagcgatctcaactttttctagaggaaagtgggctcagaaaaataagtttgaaaagtaaagcagaatctcctctcgttaatcctcagaatctgtacgagtcacagtaaattatatttgatgctgaaacaaacaacctcacagtaaattatatttgatgctgaaaaaaacaacccaaaatttctgtggctcgccaagttaagaatatatttatcacggacattccagtctgatgattcaggtgacagttaagttcaggcagaggtgccagaacttcatgcattaagcaaactcggcacctctgttcagctagtggctcttaggctctgaagttgtctatagacgagggactagagagtgaagctggaagatctgaatgtagccaacactacttctgcccacgtttatctggggacccagttacgtggccccatgtaatggtaagtgagcatgggcaatataatctagctaatcgcatagaggaaaaggaaacaaggcttggagaataaaaatcattgtttcagccctagccaccaaaacaggttttccacgaagctgatgtttatacaggcatgcagttcctacttggtgtatgctacctgcaacatcatcttctcatactcaaggagaagcacagggaaaagtacataaacctctgaatgaaatggtggaaactatcattctaaaactctgagagaaacaccaacaaggggaatagggctgagcttaggtctcaagactacaactgtgaatttgactataacacaaactctcaaggacaacaaccaagtgaaggatgtattgtagataaaatcatgcttagttgtagagattttacagacatacattcatgtcaactgccagaactctaagtggtaggaaccagtctgctacaatagatcaaatgaaaatggtttaaaaatgagcacgatgattaatagataagtatttgattaataggtctgtaggatatgtatttgattaataggtccatacacacacatatggatgcccaggcataccccatactctacttctttctcatgctttcaaactcaactttcacatgaaaaattctttcttatatcttttcttttccccttgactgcagtattcatgatatatgatatactggcaccttttaatataaaggccatcaggaacatttttgagaattatggatgtaagcaatgccacagagtgtcctttaattttttaaggttacagtggtgagctacttcaaatagtcctgtttgcttatataaatcaaatgaaaacattggtgaaaatatacacaatcagatgatataggttattaatccaaattttttaatgttcaaaaagtgatctactatttttcagaagtattttataattttagtacagctggcagttgaaacttaccattacatttcctgacccaaagcattagatacaaactcatttgttttatctatagacatgaatttaaaccattttctagtgactagatattgttgctggaacacgtggagcttaacaataaagtaagcgttacatagcctttaataaactgtgattctgtttcataatgttttgatgccatagattatcagaaaatggtattaatgttctttcccaaaataacattcataaaactttcccaaatcgctttttaactcaaaccttttatttgatgcattaaaataatgtttattggagggtttttttttttggatgaaattgagacattcaggtttatttttttaaacaaagtaagctcatttatttaaaactcaccacaagctataatttgcacacactcatatgcaaaaaaagcctggacagctgcactggtgacataggtacatcaaaaagatctgaattatctatgtgacagaacttctgaaaagccttttttctttgcatctgttttaaaccgttcttttctattcctgcatcatttctcaaatgccacccatgctgtctccatccctgctttcctgatcttcctttccctgctctattttttctatagcactgatcatcttttaatagataatacaaattgcttatttgtcatgtgtgttgtttattgtcaatttcccattctaacttgcaaattccatgggtaggtatttttgcctgtcctgttccctgatgtattccaaccaccaggaacagtgttttctccatgtctatttctatattgaaatatgaatctaactacaagtattacttgcttaacctttatgtgtgattcgtcttctttttgctcacagcaacaacagcaaagatcatcccaactgtctcttacattcagatggttaatagctctgatgactatgggttgcctccaccaaagttagaacctgctgtttgagtctaaggaccttggacccagcagtccattattcttgtgcacaccagagttaccactgaaactactcttctatgattctaagtgtttgatcactaatgcacttaattccaaattaacttgaaaaaaatccttaattccttttgaagtcatctcaaatcattttggaaacagggtcaatataagtaaatgcataaatttgctgttgaattacactttctttttctacttaatttacgttttttgctaaggaaccacttttccttacaagcagtatcaagattcttttatttcaaagaactgtagcactgtgcagatctcatgttttcctcatctaccattcatttttatgcaaatgcaaattagtctacttaaaataaacaccaggaacagctttgtaggggatgatatctccttgaaagtgcaccagacgtctctaggcaagcagggggaggtctgagggctttgatttctcctgtttctgtagcactattgttctctacactttccccactaagggctgtctcccttaggttactaacagctatagcattatcttgccttctgtagtacaagtcctgaagcagctgctgtcatactctacagcagtgttttccaatcttggagcatgaaatctgacagtatacagtagttgattaaactagctttgtttgttttttaaaaaccagaacagcatagtatagaatataataaaatggaacagactagtatggaacagagtaagatgtatcagaatactcagtaaggttaagtatcacttcattaagtagtaatttcttatcatttaatatctataatatacatgtattatagaatcaacaaagagagtgccattattctaggttagggattcttaaccaaaaacctatgatatgggctttagagttttcataaacctcttgaaattgtacatatatttgtgcttatgtatgttttatatatggatttacagactatatatgtatatatacatatgtgtgcacctatatatgtatatatagtatgcatatacatatattttatttctttatacacacagtcaagtcacgtgctgcataactgtgtttccagcaccaatgaaccacatatatgatggtagtcccaaaagattagaatcttgtatttacactctaccttttctatgtttagttatgtttaagtacacatatggccattgtgtttcaattgcttacagtattcagtaatgtgctgtatgggcatatagcctagaaacaataggctctaccatatagccttggggtgtagtaggctattataccacctaggttgatgtaagtgccctctatgatgtctgcacaaccatgaagtgtctaatgaggcatttctcagatcatatccctgtcactagatgacatatgactggagattgtttttagggacagaatcgtagctgctatcaagctttcaaactgggcttgtaacctctaagtttaggaacttcagttctaggaaaagatattctcactagagaagttcatgaatcaggaattcccaaagtcaattagcatccagtggagttttcggctattcttccataccagagcgggccatattctgttggtttattttttgagaattgttaatcttaaataatagatgaatttgaccaggttataaaaatctcttcatgttaaggtaattccttccttgtcacttaaaatttactcaataaaagtactggttggatatttttcatgtccaggccatatctctgaacttaagagacttacagattaataatgaacatttgtttataaagtcctggctgctaggcatagttctagtagatttcacaaggttattttagtacttaacaaaaaccttgaggaaaaggtattatcatcctcgtacaaggaaacagaagcttggagagtttctgttagagatagatacataaattcaccagcttggtaagacacaaagctataattggaacctgtgtcttctaatgtgttttccagatgcatgtaaaatgaatggatttctaagaaggtgaatcctttcattatgtctttcatacttattttacattctgtgtttaggtcattattagtaccattggatcaaatatgtcactgaaagtgatctgttaatttgttgttcaaattggtacacattagaatgcgaaaaggtgctctactggtaattactatagtctcaggcaaatcagaatagatggttaccccaaatgacgctaaagaatcgtgttggttttctttagggcttcttagtggtctaagaacagcagatttgtatttgctgtatagtctggttttatcacatgagcaattcatttgtatcgtattcatctgtggattgatttgtgtaattctaccataattttccattggtcaaatgtgtccttgtttcactatagatttcttagttaaataaagttcagaaatgataaaagaattgagctacatatttaaatgtctgattttctgatatatagtcaccatatccaggaattattccaactttcagtatagatgttttaacaattattgaacaaaagtaattaaaaattatgtataattttcatcattgattttaaggatattatatatcactataatagtagaaataattttttacttgtagtaaaaagatgtagtcttgaatcttggctatataattcagtctttgaaactttgaacagtaattcatgtctttaaataagagctttctcatttttaaaaggatatacaagtttctgctgtaacacctcagaggaacactgtaaatactaaataagataatatgtgagtgctttggaaattgtaaagaactttaaaaaatgtatgtctgtaggtgtatatatttacatatatacattttgatgtctacattctcatctacattaaagcttaaattattttgctttatagattttagctaatattttaaaactttaaataactatacataaacaaaaccttctatagctttaaagtaataatttaaaaccccaccaaggaaagtaatttctaatttacttcatggagctgtttcctaaaaacgccctgaagatggcacaataagtacattttggtgcaaatattactaaagaagttgtaagaaaaatatatttgaggttaaaacactaaatttaaaacaagccttttgtaagtttgtggaaaagaaatagtttctgagccttttaaccaatgcccattgttttaatgttacagaagtcatttgtttcattgcagtttaaggagcactacaaacaggtagctagtcagaaaactgatattgtcacatgttactgacaagagtcaggttagttcatgttgcacagttttatcaataaatttacccttgtaattgtaaaacagctgataagctcatctgttatcttctgcataatgtacaatctgtatctaaatgccagtttttattaggcattatggggataaggactagcagagagaaaagttgaaaaatatctgttttattaaaatataaaatacagtaggccctatttttagaaaaaatattagacagttataatgatttctgtggggttgtaatacttacaagttttaaaaatatacatctatattataggccaactatatattttacgaagatgaagtagaactcacgaaatgacagttagtagaaataaaggtgcctttggaaatacacaggtgtgaaaatatttatgctctatctatttgagtatcagaggttactgttctcagccatctctgtgacttacttgtttctctatcacacacatattaaatacttataatatgtataatgtagtctctacctattaaggatttaaaatctaaatatgaccaattatatattcatatgcatacacatataaatgttacacataaattaatgttatatattggttgtaaatacatgtccatacacattcacttactcacgttaaataaatacctaggtgaaaaataggttttgtaattaaattcatatctaaatcctcgaaggaaagtttgtgtttttatgggtgttggcaaattgtgtctcactggaagggacttctttaacttaccttttgagaactgaactttagtcccaacaaaactgatttattagtgttataactcttctataatttgtgtagcaggttttccggtcttcactagaaaaactcataaggatacattaaacaaaatgatttattatggcattcttagagcactgagatactagaggagcataagaaattttgacaatttggacgttaattacaattttttttctgtgtcaatatcccaaggcctgttgattttttttcaggatcaaaagcaatatgatttttggcgattagtaaatcacggaaatgtcaatatagtcttttcaatttagatggattgctaaaaattaaaatgatatgaagttatagcatttgggacttcatcagtttataattaggaactgaggctgggtgcagtggctcatggctgtaatcccagcactttgggaggccgaggctggtggatcacctgaggtcaggagttcgagaccagcctggccaacatggtgaaactccatcgctactaaaaatacaaaaattagccgggcgtggtggcaggtgcctgtaatcccagctactcgggaggctgaggcgggagaattgctggaacctgggaggcggaggttgcagtgagccaagatcgcgccattgccctatagctcagaccaacaacagcgagactccgtctcaaaaataaaataaaataaataaagaactgaaagtcttatcatttgttttgagcttttcttcttgtgtttctttttgaatgaaatatctgcttatttaaaatattttagtagaccttttatgttcaaaatctttaggtagggaaaatgggagtatatatttagaaaattatagattgtgatgcttacaaaaaagtcatcataagttatcaaaagaataatggatggttcaaaaatgtctaaatgcttatgaagctgattgtcaatgatgtgttatttggaaccgtatgggtcaatttgacaatgtgtacttaaggatgtcaggcgacatgttgctgaactgactgcactgcctcttttaaaaatgttttaaaaactggccgtatatacatttatctatgtggtctttgttagtatatttttcactgttttaaaaatatttttaaaaacaatttaaaaaatcttaaagaaatgaacaaaatggatgaacacactaaacaagcaaacaacgaaaaagcagagagagaggaaaaaaaaagctcttaccttgcaacatgctattttgaacttaatctgacagaatcgcagtcagtccattgtttgaaggttctcaaaagaatgtgagatcttatttgattgaaagaaaacatggctttcagtcataattttcacatttcactggacttactttattttcattgtagagtggtatttcatgaccttggcaaggttataaaaccattctgcattgatgtagcatatcctatagatgttagaatgacctggttagtataccatctctttcaaagtagtcccaaatgattattaaatacataataatatattgaatactttctgagatccatagtttagcatccagtgtctctaaggactgttacatgttaatccaaggaagaaaacggtataatctatattatgatgaaaaaatcaataaatgtgaatgaacaacattgattgatttatagacataatgaaaagtagtgaaaatagctgagagagtgataatttgctgctatgatatttcattgtaattaattagttgttcatattttcttagttgaagagattttgaaatttgactttccatatattacctgggagatggcattaaatgaaataaagcctattgttattattcccaattaataaaatcttgtgtatttgttgatagcatgcttttgtaaaacaacttttttggtggccacacaagaacacacataacaatgttgtaggcatttgaaaaaggagcatagtaagcttgaagggagtgttaaaaaatggactattttaccttcatttgcttcacttaattgttctaaaatgttaataaagaaagttgttattatatttttaaactttttgtattggtttctttgttctgtcttattgggagtatagttttacttatctttctctataaaaatagcaatctgcaaatagatatgttttaaaatgtctatagccacctatcaattaaagagtatgtcatcttctgttccaaaagactctaaaatagaagtcattataatgatttagatgtgacattgtgtgagtagaaggctctgtgaatgatctctaaatacttcttagggcattaagattgtgagactttctgaatgaagtttgggtgttccccaagcaaccattagtcatggtaagttattcatgtacatgatctccttatcttgtctaaataatcattgttagcacatgacctttagcaacattcatgttatgctcactgacagaatgtaaagggactctacatttggcatgcttagtaaatggcttcaggttttggttgcactgatgtctttctttgtgaagactctagaacacctttgacttcctttagtaacacttatttgtcagagaatatttagggacttcaatgagacactcacaaaagacagttcctaccacagtgggttcatcaccaccaccaccctactactgtagtgttttgggtgtttgttggccactgtggtgctggggccctcactatgtctttgctccctccacctctcctgcccgttgctccaactcacctttcagactgatgccagacaaatcttcctcaaacactgctcctatcgtgacctatgtgagtgagggttttgtggattattttttctttggcccaaccgtgaaaataatttaacctaatctattttcctttttgttttaagtaagaaaatgaagagtgaaattcggcatagccaagtaatcagcatccagctgtttcaagtagtgtgtagcccaccatctcttcctcctgtttaattaaattcattaagtccattaaattcgtcaagcagacaatgcttggttttattccctgatgcctaattttgcatcatattgtactgtgtataccacttcatgtcctcgtggagataagtgcagtataattcttaaacaagaaatctcaggcttttgctcaagaacttcaaatgtttcccagttttctactgtgtcagttctaagttctgctatgtggtttacaagattctctgctccatgtatttatttaccacgaattctcaaaatgtactctctgtctaattaggcctattaagtttctctgaagctgtcatagcccttctcgcctttgctttccctggagcccatcatcttgcctctaatgtactctcttttccccactcctatgtcaatctcaccattctgtccttgagagactaactcacacaacttttttatgaagcccactgtaattattcatggatctccttctttaatagtaaatgtttctgtttctgtgctgcaaaaaaaatcattcttaaatcttgatacattttgcattgactccttaactatattatacattttaggattttcgtgggtaggaattatgtcttaaactttttatgtttcacaaaatctcgaatataagattgaggactcatctagtaagcattttgtggcagagatctaacctcttttaattcttctacatattacagatttttaaattgcataggctttagttgagatacgtggcagaaaccaatgtttccttctatttctctgcattctctagccttccatcttgttctgattaatgaactatgagcagaaatgacatcaattccagaagaagtagaagccagcaggtgtgtctccaccatcactgtcttctcctgtgacttgggaggcctatgttcctgatggcagagtagcaacatgaaacaggatttgtatcagatttcaggtggaccagaaatacatctatgttgttttaagccatggaaactttgaagtctgtctcttgcagaagctaaatttaattatcctcaggagtataagattcaaatggtggtatacatgttttgtggaatcttcacgtatatgtatatttgttttatagaatcttcacatatatgcatattcaattttatatacatgtatgttttatagaatcttcaaacattaattcagatatttgtattctctagaactccagagttctgcaacctccctaagaatctcttcaaagtaaattaacgtcattcatatctacagcaaacaaaggcacctatataatggttttctcagttatagcaaatgttggctttgactgcattttgacattaaacattgttgatgccatttctgaatctactgcatagttgtaatcttagttggaaatactgttggttactggttggtcaaggagattaaccccggagtttgagactttattcagagttcttcttttggacttgaaaaaaaatctgctaagagaacttgtcccattttaggttatgctgaagcatgacaagatgtacagaaatattctgaattctaaaggaagctcaatattatgtaatctcaatttgtagtataatgaaaaaagtgtgaatgagaaagtcaaggagtaaaggtgaatttgatattccataacttcagttttacttctgctatatatttctttattaatagtaatagagcacatcgccagtcatttgataaggagtgattaaaaaaatccgttaccgagaaaagctatccttttgaagttctctcattttaaaaaacacagttttaagtatcagattttttctttctaagttttaatgttaaccatgagctcatgctgtcatagtggcttaataagaattactactacatataatgtgaacaaaaaccttcatgtttattttgatattcaaaatgcaaagttggaccaagataaaacagttagttatccagctaataaagatataggtatgataagagatacttagacaatgaaacctctcatatactattggtaagaatgtattcttcctggaaagcagtttgaaaatgcatacgaaaatctctaaaaatgtattctttcccccataatcctagttctcaaaatctatgctaaaagataatcacagatattataaatgtgtgtatattaatttttcatagttcttaaaaaactataaatcactaaacgccaaaacaaaggtcacgattaaatatactttggtacattttgatgatggcatattttgcagttgctaataaacaatttttaaagataacttaaaatatttaatggtatgtgaaaatgtttgcaatattaagttgaaaaccgggtatcaaactacatattcgatgactccaatttaataaaatttatgtagctactttgaaaaaacaatgaacagaaatacacagaaatattaacatcaattgatgttggtagtgttttttgctttataaatttatacatatagaaatgaagaatatagacagacttatagaaactactaaattattaagataagcatctgttgccttgattaatggaaatcaccaaattctgcgccagctgtatggagtgtgttgtaggcctgtcatctttctgttcatgcggttgctattacctcagaacaaatgaacaacaacaacaaaacttttcatcttctcagactaccttacttcatcttagccaccaaggacagtggaggtgccagcctctgtgacaagccctccctgccccacttcagattgggttgtgtattcttcctcgttactcccactgtgtccagcatattcccttacaacggtaataaaatgggattgattgcttggctgggttcgccactggattgtagctctgcagatctttgaggtctggaatatcttttccacgttcttagcattatagcacaatgacaggcacacaaatggcagtcaataaatgtttgtagactgaaccatgtttaaatgacttacggcagtgtgtaatgcagagtgaagtgctgtcttgaggcaggttccattaaactcctgatttgattttgctctggaaatttccggaatctaagtagtctgagagtcctatatataaaaaaatatacacatcaacttttgctattcaaagatgatttagataattataaaaacaatacattaaagtaatgttgttttatatttcaggaatatttttcattgatatatgagagtttctgattaatctgaataactaaatttaagctttcaaagccaggatgttaatggtagtctttaacaaattgtaccccctttttagactctgttataaattataaagtgcactggtactaaacttcccaactcaaatcacagtgatgtttcataaatttatttgataaggttattcattaatttgtgtgagaaagacagttgtcatggtaatagcttaaaatgaaccgaaacacaatcctggtcatgtttgctaaagcaggtgaatctgctctattgtgttgcatttttctaatttaaacataactgaagcaaaatacaaagggaatttaaaatgaacatttaggggtgtttttgctatatatatatataaaataaagtttcaaaaatccccgaatttggagagtctgttctattggcatactcgatattcgcattcctgagttttccataaaatgcagattttattcagaatgattcagatcaatgcaactggactttcgtctgattttcagagaatgagttaataaaatggctgagatgtgtctggagaagaaggcaaacagataagattatttctgtgtacaaacatgttatctttgattccctacccaagctatttggtttatcataacttgccatgatgataattaggtgacagaataaatgaatgtgctttcatggaagaatggcagatgcaaaaaataataaaaaaggcaatacctgagcttgagtaattttattattgtgcattcagagagttttgaaatctatggaattcctgctgggaaacaaattttcctcactgaatggatcattaaaaagtccatttactataacaaaatgcatgttctgaatgtgtatacatttgaatttgcagatttttttcccttcaagtatagatgcttgaatttcattgatataatttaaaaagagtgaaacaaatttcttaatactaagtagttttatttttttgtaaatgttgctatgttcaaatagcatttggcaaaaatcattgcttatagcattctgcgtaaggaaaataaaatgtagttgtctctcaaattgtaagttataccttattgtttacttgaaagtttagtgctgtattttaaataaaatatattcaatgtcttagagtagcagtcatctctgcattttagagccaaaatctcaaaacaaatcaggcgtatgtgtgtaaaatatgtgcatatttttaactgctgcataaaacacaaatatacataacatttttacataatcccagcctcttaacaaatgttacagtaagataccaattggtgaggttcaaaaaattaagatgtggatgaaaaataaaattctgcctctcaaaaattgcctggaatgccacttacattttaattccaagaaaactcaaatatcaataagataatctttttggatgtttcactcataatgtaagatattcaggtagtttttaatttgtttaaattttaggtttgggggtacatgtgaaggtttgttgcacaggtaaacacgtgtcttggggctttgttgtacattacatcacccaggtattaagcccagtaaaatcccaacaaattcacatatcatcttatccatgtgacagtaaatatccaaataaacaattaaaattgagtactaaatttttataacttactctgtgcgatattaaatgagaaaatatttagttacatccaggtaattgactcagttccttgtgtctggtatgtaactgttaaaattgaaatacagataaagtagattatttaatttttgaattgtgtaaatgtctgtgtgtaccaaatgaggagaaaagtcacaaaacccaattcccaaatcctaggtattgcatatgagatgcaggttttagttatgcaacaacaataatgatttctctgaacagtacaatctttaaaaataactttcggagtgctgattttcataattacaaataagtgcaatttagctagtaattaaaatgaaaatgttaacaaaggctctgcattgatgcctcatttgcaagtacaggcaaatgttctgaggcgatctgtctccatgcttaattcttacttgaaaatttccccgaagatattccttgccttacaaagtgaagtgaattgtttgaaaaaatattaaagagtaattttctatatcattctttaaaaaactataattattcacaatatcttagggtataagtaacagcataataaacctattctggcaacattaccccctcatccttaccaattcatgtactcagatccactttatatgtctattccagaaaatttcaagatgtagtaatcactaacagtaatgttatccttttcagacggtaaaaattttaacttttttgaataattggaacaaatgacttcttttagccaagtacacattttaatgaccatacattttcttgttagcagacctgtatattaggcatatttactactatactttgatttaccttgagatcaagctttgttccattgtctaaatttaataggttcaaacattttctttacaaaagaaaatgtattactattttatgaagaatgtaacctatgatttttctaatgtttctagtgaattttcttctggcttaaataatatctattaaaataaagcaagttaaattaactttgcaatctgatttctagttcttttctctagagccattacaaatgacttttactacagttctatatcatttatagtatatcctgatacattaaatttatagaaaatgtactcaaattgatatcttttaaaaaattttcactaaagggtgtattcatacaaaatagaatatgaattccacaatatgacttgttttatattaaaaaattattatttttaaaaatgtgttttgcattatttacatctggtgaaattaaaatatgaaagaaatacgtatccatggttctttggaaagtgtagtaaatttgaggtctatgtatgctttattttaatgtgaacacagaaaaccgtagaggtgattattttttccctttggagataaagcagttgggtaatggatagcaagccacctgtcttctgctcggagaatgtactcttgttgctctgggttcagagagaatccctcctggtacccattgccatgtcctatattgtaagttaataaagttacagtctaatggtctttttgagtaaagtacacttctgagtctctttttgcccaaagggtctgcactattagtagagtcattcccagtgctcctttgatattttgcttttctgtcctttcttgtgaatgaattagtaagaacagtgatattaactattcacttgcagtgttggttccattgcattaagtggccaaacataattaattcctaaaatctagtcatttcctctgtcacgtttattaagtctgcaaaagcaaaacaaaaaccccattttattaatacagaagtattttttatttgttttggaggcttactcagtttcatctttttctttagcatgcttttcttgtgtaataaacatttattctcacagcaacatattcatttcaattatgctatcagttaaataacttattgaatttgtgtgatcattttcctccctcatttatctaaatttgttagcgcctcacggtttatgaagggtcataaatagtttactggatttatcttttccaattttaatctaattcttatttacccatgactgctgaagttatccaactattgttactgagatgatgttgggaaatgacaaagaaagtataatttgatgtacaattttgtacaatctgtattttcttatgctccttctgtttttgttgttttgtttggcatttttcgagacagagtctcactctgtcacccaggctggagtgcagtggtgtgatcttgactcactgaaacctccgcctcccacgttcaggtgatcctactgcctcagcctcccgagtagctgggattacagacatgtgccaccacccctggctaatttttgtatttgcagtacagatggggtttcaccatgttggctaggctggtcttgaactcctgacctcaagtgatctgcctgccttgacctcccaaagtgctgggattacaggcgtgagccactgcatgtggcctcttatgttcctttttaaaaggcattgaaaaaatgtgaacatttgatagtatcctgttgattttatgaatgtatcttactcttaacattttttttctttaagatatatctgtaaatgttaagtagtattcatattttattaactggctattttaaaattgaactttcttcccatttggtatataactagcatttttccactttgttttcagaacctgtttcatatccatgcactctgttcctctagggtattaggtatcttcatgttagaatgtaggaatttgctagggaatatttatttattaattgtgtcctatatgttcaacattggaaagtcacttggtgatcatccatgaaaagtcctcttgttttctttccagctattacacattttatctatctagtccccactaatacagatccattatatcttttccatataattttccttgtttgccccaagttatcttctccattgtaagatctcatctggattaattttgaagattggtagaaagtcctttctgatacgttttccatctactctcatcctgctaggctctcagatgcttacagttccattattattattgtgtaagttaaacactattttgagttattgctctcagtgatcacataatgaattattatctaaattttcttgccttaaaattttaagggccacattatggaactgctggcccatattaaaaatgtgaactctgtctaaagaaccttttactggccaggcgtggtggctcacacctgtaatcccagcactttgggaggccaaagcaggaggatcacttaaggccaggagtttgagaccaggctggctaacatggtgaaaccccgtctctactacttgggaggctgaggtgggagaatcacttgaacccagatggtggaggctacaataattatgccactgctctccagcctgagtgacagagcgagactctgtctcaaaacaaacaaacaaacaagaaccttttatcactcttcaaccagtgtgcattactcagacttggaaatcttttttgtcctttcagggataacccctacctctagaattatttactttctaaatttgagtgtgaaaatctaacgaataagatttgccttattctctttgatctttgtgccaccaaaacttgtgaatgtttcatttattactaattctctatatttgcaaattgcacattaaaaaaggtgaaatcacatttttcaaaggaaattgtttaatttttatcaatgaacacttcttaaaatgaaaaaaagatgaacttcccttactttcatttctaaatgtagttacatatttacagtaagagtttaggtatacatttacaatgagatgattaacagaaagcattaaatatcctgaattgtcagatgggagagctttatccacaaaaactccttgatctcttttgcctgtgagctttctcagcttttgtatctcatataatccacatttgttctaattttatgttgtctggaatcctttcatgtgtgttagatttgcctcttgaggtaaatgctaaagttttttacgataaagcttatgtcacatatttgtatattacctctatttctatattttcaaaaaagttaatttgttaatcaaaagattgaacttgttagttactaaacagattgtctctaattgttagacaaagaatatttatgtgagcaattgacttttagcaatagcaccataaagataaaggcatattaatttaaaccttaatttttatgggtaaggaaaatgatccatagaaattaaatgaacattgaaagatgatatgacaaaattgttcttttaacctttttgaaatgttcactttttctaaaatgtgcacttttgtacacattattcatctttagcatctttagtactggatcagtagaaatagtattttttaaattttacatgagtggctattaaagcatacactaggggtctttaaattataaaacctaaacaaggccgggcgcggtggctcacgcctgtaatcccagcactttgggaggccgaggcgggtggatcatgaggtcaggagatcgagaccatcctggctaacaaggtgaaaccccgtctctactaaaaatacaaaaaattagccgggcgcggtggcgggcgcctgtagtcccagctactcgggaggctgaggcaggagaatggcgtgaacccgggaagcggagcttgcagtgagccgagattgcgccactgcagtccgcagtccggcctgggcgacagagcgagactccgtctcaaaaaaaaaaaaaaaaaaaaaacctaaacaaatgattaatctctcctaacactaaaatattttaaaattgattactacagtgctggtaatgatgtatacctggcagctgaccgtcaaatcttatgaaggattaaaacataaagtttgcattaaaggtaagatttctatgtatcttataactgtttcatctcagaaaacaatataacaacttccttttctaacaaccagtatttcttttttcacaaacataaatctgtgagctattagcaaacactgaattgacattccattgaaaagatacacactgaaatttacagtgtaaaatacattttatgtcctctttatggaaaacacaaacacatacctacacatgcacacatacacacactcacactcacatggaactctatcaacatagcataactaactgcaaagtatgtatctaactaaaaacatcgttatgggacaatgattctctccttgaccaagctcttttcaggctcctctgaactcttctcaattaggccctgacttttgggcttctgtgtttatctctgcattgtccagctttagcaagaatcgtgctgagccaatttataaaagcacccctccatccccagttcttggtctgactactctctgaattttatcacctggcctgccttcagcaaaactccttaggtcagctgaacaaataattaccatacctcctaggaattgtccatccagcagcccctgactctgctcctttgctataaatccttttttcttattgtatctggaattaagcccagtgtctctcacctgctacaatcctccattgtagtagcccattttgaattaagtcttccttatcatctttaacaagtatcttcagtaatttttctttaagataaaaatatattccagcaattcagtttttacacatttcctcttagatgtttatcattctgctttcttattagcaattaaatcataaaatatagttatattcacatttaatatttgcacacttacaacatgtagtctttgaatcaatagccctaacacttaaaatgtgcttcagaatggccttttctccttaaatatgtttttcttagcccactggataaaaatgcaagttattgtattgaataatataaaccagtacacatgttataagcaccatattatatgtctctgcacaagacagaagaatgcattttccccctcaaatagacatttaagttctgagaacaaaacaatacataggaagtattagagagaggaggttggagcccccactgaacaacatgaagcccctcacctgtttgtcccctgtttgtcctctgtcacatcaccttttcagtgaattcaataccaagccttaatgctgcagttagacactaagcaatgatcttttgttcattaactgtatactccttgatgttcagctctcatttacacaatgtcaatatgcttcttgcagttctttttgctctttcaaacaaactatgacctttaattgaaaggagaaaattagttatgatactgtggcaggagataccttctgggacttgaatttgccagaaaagatagtagctaagagtttggtgccgagaaatctgggagtagagaaaaaataaagtggaaatagaagaaaagtgacatgtgaaacatatttataataaacagattaatatgaaatctacataaagagaatagactgacgcctgaatatagcattcattgtcttctgtctcaaatttttattttcaaggactgacagtaggctgcttgtgtgtaatgataactggcttttttccttccttttctttctgaaatcatgctgttggcggttaatcagtcataataataatgttacagtgtcctcagcacttgtcctcctaaaagcttaaagaacacaaaatgtcctggttcactcattggttttatttttcccaaactccatatccttccattgcgcagcctctgggcccaattaaatgatttttaaaaattaggttagtaaaaagaaaaaaatggcttgttttttgtagatgcaaagactaaatggtccccctacattgaggagctgacacagacaatgataacagaaagatgaaaaagcaatagaatccttgcatgtgcccccacccgctccccttccctcttattctttgcagggacaaaagaaggcagcattcctttttccatcatctgctgtcacaatactgactggcttgccttgcaaaattacctctagaatgacacagaatttgtaccaagtgcaggcagatgacaaaactgaagatcaaataatatgcaattgagaaatgatttttaggtgcttttcaaagcattaaaggcttctaggtattggccccgaatagtggtgtttatttcatgaatgcatgaaatggatctggcaatttttcaataatattgacaaacattacctcctctttgaagccttcctcaacttgcccagccagaaaaagtggtctaaggactgctcttatcagaagaaagctttaggccaatatctgatcatctaaaggaccttgaaggatttaaagttactgaatatttgaaataaaggccatctgaaaattctgaaatatatgatcactatctattttattccatttacctattgcgacgtgacaaaccagcccaaacttagtgacaaaatgtcaatcattttattatgcttagactttctgtggatcagaaataaaggcacattgcaggcgtggttttctctgctgaatgtcagggcctaccctggaaagccttgactggctggaggtgactcacacttgtgagtcatctgcaggtttctccatctgcgagttgggttcttgggctggggtgactggcaggctcagcggggactgtcatcagagcacttacttgtcctcttcccaggaggcttggcattctcacagtacagctgctggctcccagggcctgtgttctgagagggaacatccagatagtagagattccagaaagccggatagaaaccttatgcctcaggatcttgctttggaagtcacatagcatcacttcttctgttatctacaggtcaaaacagtcacaagcctgctcaaattcggaaagaggggacggaaatggaacctcttcatgggaggaaggtaaaagaatttggtaccgtctttaagactaccacattacaccgatggcatcttctccacacttttagcacagcctctctgcagctcgatgatctgcagtttgttttctcttctccccaagtgactatgagctcatgcggggcaaaaattatttataaccttaaaaaattatatcctaagaaactgtttattaaaatgagacactataaatattgaatgaagtttacacacacacacacctagagaaaattacaatgctaataatcaaagacaatctaaagtctatggtttaatctcttacttaaatacattcatttgcatttgagtaactcgacagtgatgcagggcaggcgacccccggaaactggggtttagcccacgagggttattggcttcacccaggaaagaattcaagggggagccagtggtgttagacagcaacttttattgaagcagcagcgtacagcagcggcagaggtatttctccttgtggaacagggccaccccatagacagtgaactcagagtagtggctgagagccacttctgtagtcatatttatacccacttttaactacatgcaaattaaggcaggatgatgcagaaatttctaggaaaaggatggtaacttccaggtcgttgggtcactgccatggaaaggggtggtaacttccgggtgttgccatggcaatggtaaactgatgtagcacactggtgggcatatcttacgtaatgttgcttttgccccagatgccctggaccttttaactagtcctcaatctggtccagtttccgagtccctgctccagagtcgagtaccacctcctacctcaatgggcaagagtctagaaaatttaatccttaaacctggtaacttacataattatttttgtttggatgcattctaattgtttcaaggttttctagagatggacaattgagaaggtggcagtcttgcctatttctagcaaaatttcattaaataaatgctggcagacaacaacaaaaaagccctaaaaagagtgtttgttattttgccctccaggtgcagattgagatgtgacttttatcaattaagaaaattgatcataagaaaaaggagattgtgacttagaagctttacctctagatttgtcgtttatattcaaaagtacattgacagtcctctgttccttgaacaagacaacatgcctctttgcagagctcttgcattagcttttcttttgtcgagaatgctttttccatagtatatacgtgcctcattctgtcacttttttttttttttttttttgagatagagtgtcgctctgttgcccaggtagagtgcagtggtgcgatcttggctcactgcaacctctgcctcctgggttcaagcgattctcctgcctcagcctccccagtagctgggactacaggcaggtgccaccatgcccggctaattttttttagttttttttttttttagtagatacggggtttcaccgggttagccaggatggtctcaatctcctgacctcgtgatccacctgcctcagcctcacctcccaaagtgctgggattacaggcgtgagccgccgcgcctggcctctgtcactttttaaaaacaacagcttaaatgtcaatgcattgtccttttctaactatactttatacagtcgttactcctatcagtctatctagttttgtcagagtatttacctaacagaaaactacttatttgtttatttatttaagtcaacctcccttactggaatgtaaattgcataagcatagggcctttcagctttatcttctactaccattctagttcgtagtacagtgactgttgcataataaacaatatacaattgttatataaaagaatgagtacaaagcatataaagacaacctccattgtacaagggcatggagaaaataaacagtgatacatttaatgaatttatgtattgaacaattttaaacatcacatctaaagagcttaacaagtatttgtttttatagtttttgctgaagcaccaaaatagaggcaaagttttgtagaggccaagtgctaccttattctcaaatggagttttagatcatccatgaattacttgcaaaagggacgtcctgaaactctgcaccactagaccatcgtacacctttaatgaattcttagatgcattttatatatgatgtatgtacataaaaatgaatgaattcattagaagacattttaaaaatgggaatttccgtggacaaagagttttaggaaagttgagtatttcttttgaagctacgtgaggagagcttttggaaaagcactaaggaatcttgatgcgtatgcttcgtgcttctgtagacacacagttggcacctgactcagatataaaaaagtctcaaggttttattatcgctggcagagcaagaggagagatggcaagagtgagacactgcaacccacccactgatgttggggcgaagatgccctaggccagacctataacacataaatagaaaggagctggacttgagggacttgattttgaacaggacactgtcaaaagcccccacctgggaaactgtactaatagcccccacctgggaaactgtactaatagaagagtcagcgtggggtggtgtgttagtttgttttgatgctgctgatgaagacatacccaagactaggcgatttacaagagaaagaagaggttgaattgcacttacatttccgcacggctggggaagcctcacaatcatggcggaaggtgaggaggagcaagtcacatcttaacgtggatggcggcaggcaaagacacaaagaatgagagccaagtgaaacagatttccccttatcaaaccagcagatctcacgagacttattcactaccacgaggacagcatgggagaacccacccccacaatccaaccatctcccaccacgtccctcccagaacacgcgggaattatgggagtacaattcaagatgatatttgggtggggacatagagccaaacaatatcaggtggactgccagtaaaaaggggcgggcgtgtgttaatgctttggagaaggcattgtgtctctgataggaactacaggtgagagagagatcccagcgacagaaggtcgccaaggaatctgtgggagaggaaataagaatttgcctgtctgttcccagttgtttgagactggggagaagacgatgagaaaagttttaaattggatgagaggttgatactcagatattaggcagaaaggaacttttatacccctgaaaaatgagagttcttcttaataactaactagaaaaaaatgtcagatcggcctaatatttcatctggggataaataaggacagttcaaaattagaaagagcagtagtgaggaaaaaaaaatggtcactctctgcttttaacctgacaactcttattcagtcaatttaaatgttatacaggttttagataaaatactaacaagtaaaacacctatgatagagttctgagtaaaatgtacagcattctgtacttcataaagaatataaactcaagtttattatatatattacatgttctctctatattctttctatataatctattatatgtgttttctctaatagtaattaaaaaaaccccacacatacaggtatctatagaaaaaattggatgctgacacacttacctaatgttaagacaattttttccccagggattgatttaagttttcttctttatatttatttcctctggccctggaggcagtgtatactttactcattctttgatgcaaatgcttttttttttttttttttttcagacggagtctcactcttgtcgcccaggctggagtgcagtggtgctatctcagctcactgcaacctcctcctcctgggttcaagcgattctcctgcctcagccttccaagtagctaggattacaggtgcccgccaccacgccctgctaattttgtatttttcggtgagacaggtttcgccatgttggccaggctcatcttgaactcctgacctcagatgatctgcctgcctcagcctcccaaagtgctaggattacaggtgtgagccactgcaccgggccgcaggtacttttttgaatcctttgaaggtgtctgttggaaaatgtgattacacttcccaggaagcaggtgataatctctccctaagccccttgacaatggatggtccagcctcctgttggggttgcttggtcctttggcatgatttaaaatttcttaggcaaatttttattttcaggtaaccactcgctggttgatgagaaccacctgcatgctgttgcccctgctgatgagggaattctagctggttccagggctgcttgtgctttctctgcacagtactttcttgttattaccatggcctcttgcctttatttcataggcctttgtcagaccctgggtaacagttttcctaaatatccagggctccaggaggccctttttctaggcttaaaactctcctaacttcttcccagtcgggaaattgagacttagagcagaccaacaactttctcctaaaataaatcacctcctctatctgcagcctaggtcagcttctctaactcttttaccagctggaggccagtgatctgctaaggtcatatgtgtgcacgtgttgctgggtgagtctagctttctataggctatgggagtggttgacatacatttcctaggacttcgtcatacacataatggaaataattccatgtgagcataccatttttagcttactaaatccaaaagtatattaaaaggtactttatgataaatagaagaatagaagaatattttcactttgtaaaagttttcaatgttctaattcactcattaacagtaaaaatcacataaatatcttgatagatgctgaataagaattttataaagctcattatttattttaaaaattgaaacaaacaacttataaagttgaatttctaccatattatgtattttttaaattctcataaaattgaatggaaacttccttaatgtgttaaaagcttataccaaaatataatgtaaatataaataattgatgcatatacatcaaatatcacatttaaagattagatacattatcttaaattgggagcaaaacaaatgtccaattttaattattggatttcaataaatcacttgagattagggctaattctttggaattcatgtaaaagaaatatggattttgaaaattttgagaaaaaaataaaacattataactctatgattacagagatatgatctgcatgaaatcctagtagaattaacaaagaatgagtgttaataagagaactgaacaagtttgctaaacatgaggtcaactttctcaattcttcagcattcatttaagtaagtaatgccaaccaaaacaaaaaataatgtaatataaaacaatagcaacaaaattttaaaagtatttagaaattaaccttggaaagaaatctataaacctttataatagaaattttaaaattgtaataaaggaaattaaggaagacctaaataaatgtggaaatctattatgtctttatttaaaaatataaaagtttttattccaaaataaatgtataagttcaatgtaatttcaataaagattcagtagtacctttgaggaactgaacgtatatacgtatatacaaaatacacagatacaaaaatatctgtgaaaaagtcagctgacagaagagaaacaggatatcttcttagtgatatataaatgtattacaaagcctaagtaataataatataggaaataaagagtgaaaatattaatgtaacaaaatagagttcaagagcagaccccttgatctgggaactagataaagatgaaagtggtatcatgttcagtggcaaaaggttgaatggttcataaattgttttgggaaaacagacttacaaagtataaaaataaaattggccttctatttcatagcatatacaaaggaggactgctgattgattaatgatttaaatgcaaatagtaaaaccataaaaaataatggggctatggagacttcattacagaaccttaaaagcacaatgtatatggatttaactgcaatggatttatcaacataaaaattcaggatatttttccagcaatgaatattacaaaaaatattaacagatggacgacagattgggagaagatatttgcaaagggtttaatattaaaactatacaaagaatgtcttccaagtaaccaaaaagatgaaaaaattagtaaggaaattggcaaaggatataaatggcacaaaatgactgaaaattatgtgtatagatgtgcaaccacattagtaatcagataaatgcaaaataaaataaaatactacttcacagttattggagtccccaaatggaaaagaagctgtgttgataagaatatggagaattgatgcttgtcatccatagcttatgggaacatagagtggtgcagcctttctggaggaaattacatggtggatttacaaatgcttatatcgtactactcaacaatgtgatctttgttattttattctggaaaaatcttgcccccattccaagcagggacatgttttgtggaaataggtaattggaggcaacatagctattattattaggggaatgaataaaagcaaaatgtgttgattacacactatggttgtagtagtctgttttcatgctactgataaaaacatacctgagactgggaaatttacaaaacaaagaggtttaattgggcttacagttccacatggctggagaggcctaacaatcatggcgtaaagcaaggaggagtaagtcacatcttacgtggatagtggcaggcaaagacagaatgtaccagcaggggaaatgccagatgcttataaaaccatcagatcttgtgagaactcattcattatcatgagaacagtaagggggaatagcccccatgattcaattatctctgcctggccccacccttgacacctggagattattacaattcaaggtgagatttgggtgggcacacagagtcaaaccacgtcaatggtattcataatcaacatgtctgatcttaaaaacttcatgttgactaaataaatagaaaagagaatattgatagcatagtaataattacaagtaccttcacaaaacattatccttgttttagaaaaaattctcatactgaaaaaaaaaccaaaaacatgaaatcaagcatttattccattgatagatgaatgggggtaggactcagggaggaaggtgagaaatataagataaaatatataataaaataaaataaaacaaaatgggacctttaagactgatggtgaacatgtatcatgatttatgtgaaatgtttaattcagttatttggacctgtggtaaaaaatcaaataccaaggggtaaaaattaaatgaaattttattttaatgcacaggaaaattgatcatgcagacaggtcctattctactatcaatctctttttaggaaatccctttacaaacagtagactgttgagcattgtttcttcacattttctgtatgtgaagatttaaaatattaggcatttttgaatatggaattgataatgtatggtgaaggcaatttgtgtgtttttacaatgctatccaatacacaatgagtatgtaaaacatttctgtcaacttcaagtgtgccattttgttctattacttgccaatattttcactgcatgaaactaatttgtttctgaggagttggtgactttctgtaacatattttatggacaatccaaaacaatccattaagcactccctccccacactccctgtttttctgttgacattcagattcaacacatttataaaattaaggactgttttgccaatctcaggtaccaggtgtactacactttgagggttatttattttcttcaaagtcagactggattttggcccatacatcatttgaacttctctccttgcattatttgtctataggagaaatattgattggaaaagcagtgtagaataaagttaaagttaggtatcctatataatttttcctaaataattaaaaatgtttttttaaaaagtgatgttaaaattgttaagtaaaatccaatatgactgattcctgtattgacttcccaaggattaaaatctcattagataagcatgtaatatgtcttacatgataaagtatccataagagtagctaatagttttcttagcatgtaacattcaaaactgagcaattaataatatggagtgagcagtagctaacagtatttaaatttaatgaaaccttcacaaattcatgttcttccatttcacagaaggagaaaaagctgatatttaacagtattcagttttttgggggaatactttttaggagtaataatattttctaagtgcttattcaagataagttttacattatgggaaaatgcaagttattaattctcattagatttatttagtgttctgtcactcttacatttttggagattttcctaataagatatgtatattttggcatccaacctctcaatatcttgcatggtatttaatattgatatagatattcctttttgttatcctggagtttgaaaatgccagcttgtggtatgtcctttgtatattatgaattaaaatatttgccattctttaaaataccatgttatccatgattcatcttttattaacattaaatccacagactgccataagcatagtcttatcacagtttcttctcacctaagtatttaacaatataaatcaatgtgttagacgttctttcatgtgctactagggaaaaataactggcttttaaatgatttttagttgtaattataacaatagctacagttcttctcctgatggctttttttcccaggtggcctatttttatcctgacatttttgtccatcctatgaatttcatcatagggaaggaacagcagtttgtcttagagcagctcaatttcaatctccaggtgacaagctgatatttctttcctttgaagaagcttttaatatgatgggttaaatgtcaaggaagaaaaaaaccatcatatattgaaccttgataacctcatttctcttaacatattgacatttgatttttaaaaaatgttctattttttaacagatgtcaagatttttaaataatgcatttatttaggtatcttgcaccttgttacaagtcatttagggtaaacacattattttggtgaatacaaaagaaataaaggtatttactcatcttcagctgatagtgtaaaaagaaaaactgaattattacactaaaaattctgtgatagattgtattcattttagtttaaaaatggtatctactatgaataacatgaaggagtcaaaagactggagttaaagaagaaataacttctatttattaaatggtaaaaagaaagtaagttacaaacaggagagtttaaaatggtttcttacactggcttctgaaatagattttacattacttttttttagagacacaactatttaaatattgagaaaatagaacattatatgtttaccgtttacctaaggccattaattatacaacaaatattaaatgtagtaatgtgtctagaattggtgggttcttggtctcaccaacttcaggaatgaagccaaggaccctcacagtgagtgttacagttcttaaaggcagcgtgtccggagattgttccttctgatgttcggatgtgtttggagtttcttctttctggtgggttcgtggtcttgctggctcaggagtgaaactgcagaccttcgcggtgagtgttacagctctttaggtggcacgtctgcagttgtttgttcctcccagtggcttcatggtctcactggcttcagaagggaagctgcagccctttgcagggagtgttacagcccataatggcagtatagacccaaaaagtaagcagtagcaagatttattgcaaagagcaaaagaaggaaccttccacactgtaaaacgggacgccaccagattgctacagggggctcgggcagcctgcttttattctcttatctggccccacccacatcctgctaattggtccattttacagagagtcgattggtctattttacagagagctgattggtctgttttgacagggtgctgattggtgcatttacaatccctgagctagacacaaaagttctccacttccccactagattagctagatacagagtgctgactggtgtatttacaaaccctgagctagacacagagtgctgatttgtgcatttacaaatcttgagctagatacagagtgctgattggtgtattcacaatcccttagctagacataaagattctccaagtccccaccagattagctagatacagagggcggattggtgcatacacaaaccctgagctagacacagggtgctgattggtgtgtttacaaaccttgagctagatacagagtgctgattggtgtatttacaatcccttagctagacataaaggttttctaagcccccactagactcaggagcccaactggcttcacccactgggtcccgcaccagggccacaggtggagctgcttgccagtcccgcaccttgtgccggcactcctcagtccttgggcggttgatgggactgggcgccacggcggaacagggggcggcactcctcagggaggctctggcggcacaggagcccacggtgggggggtggggggtgctcaggcatggcgggctgcaggtccggagccctgccctccggggaggcagctaaggccaggagagaaatcgagcgcagcgctggtgggcgggcattgctgggggacccagtgcaccctccgcagctgcttgctggccggggtgctaagcccctcactgcctgggcctgctgaccactctgagtgcagggcctcggagcccacacccacctggaactggcgctggcccgcaaacgtcacgggcaaccctggcgtcacggcccgcacctctccttccacgcctcctggcaagctgagggagctggctccagcctcagctagcccagaaaggggctcccgcggtgcagcggtgggctgaagggcttctcaagcgtggccagagtgggcgccaaggccgaggaggtgctgagagcaggggagggctgtgagggctgccagcacgctgtcacctttcagtaagccccttaccaagcttgaaaagtaatttcttttcagttttacagcataaaaacaaaatcaggtgccgcaggagatgtgattcatgactcttacatagctttaaaatgaggaggagatatgggaggtttttagcctcttaaataaatgctgcaagtatagcttactccatttattctttctaacaatcgctatacacacaaacacaagtatgaacacatataagatgtgtagtctatacttttaggatagtagccactagccacatgtaactacttaggtttaaatttaaattcattaaatttaataaaataaaaagttcgttttctcattttcccattttaagtgctcaagaatcacctgtggctgctggcttcccgattgaacggtataggtctaaaacatttccatcatcgcagaaagttctattggacagtgctgctaattgatttctcagtgtggaaggaggtgtctttaaacacctttgattctttcataacattacattcaatattttaatatctagtcatacatattttctgctgttatggagctacagtatgcatccatgaacttttcacaaatttctacttaaaaaaatcaataccactatgtactatcaagttcttaaaaatttaagaacttaaaaattaatgtttaagaaaatttaaaatttaagtttaagaacttaaataacaggacagcttaaccactcatcacatcatagagtaaagaagatacactttcttaggagaaataaaaaagattaagtattcatgattggttactgctgtggtttgaatgtctccaccaaaacacatgttaaatttaattgccaatgtaacagtattgggaggtggggcttttaacaggtgattagcttatgagggctccaccttcatgaaaaggttaatgccccgatggaagcagtgggtcagttattacaggagtgggctcctaataaaagtgcaaggtggacttatctctctatcttgtggaagggtgccttccacccttctgccatggggtgccattcaccagatgccagggccatgctcttggatgtcctagcatccagaaccatgtgccaaataaatttcttttcttcataaattatccactctgcagtattctgttacaacagcaaaacacagactaagacagttatttactttgcaattaacctttaaaaaattagtcattctttcatttgtttgaaggcaagattttgttgtttgaatttgtggcctctactgaaacttctcttcgaataatttttcttcagactgtgttattttgtaattgcataaggagtctgacattctaaagaatgctttgagggaattatctttttctaatctgaaaaattattggtaataagggccatggtaatttcaatttcagtttcaacagaatatttattatattaaaacacaaggggcacaatttacaaggctagtatgatatattaggtgtagtttaaaaatgataaagtgctttaactaaaagttattttatatcaacttaattctctatcaaagtaagtaactttatctctatcagagaaaagttaaactgaagttcagaaaggttatctaaattaatgtaagttgtgattgcaaagtaaggatttaagcttatgtcctccaaacttgaagtcctgtttttcaattctatagctgtggtgtgctggtaaaccagctcgtaaaattaaaaaaaaaaaaaaaattagtgctttgccacatctgctgacttttgtgatgtaagtactcccactgtggctaaatttaagctacgaatgatttaaaaagcggctacaaaattgtcaaatatttcattattgcctgtcctgagtcagtctgagtgactgcagcaccccagtgccactctgcttttctaatatacagaaaaattgtgagtgaaggggagtaggtggaagaacattgtagaattatggagagtcacccttttctgctcctgaattttattacatagtattttcaacgagggagatctatctgaacattcatccaactatgattattgaaggtaataaaaatacatatctataattattttctattggaactttgttgcatggtacaacagattctaaaagaaaaaatctagtgtactatcattttcaatgaaaattcaatttgattctcttttgtgctctctcaacaagctgatgccaggctggcgtccaaccacaggtaaagaataatgctgaatgatcaagtaaaacataggaacaaccacatgcatatcttgatattacatgtctccaatgatgagactttgtcctcagaacagaggagataactttcgactcaactgaccatgctatctaataactatcataaagaacagcataccattatacaatgttaaaactattggttttgtttttacagatgttctccaaattataattgcaaataatcattattaaaaattgcacttaacaggccaatttgttcaattacatgcatgcatattttggtgttaactgaattctctaggtgcaatgttgaggcaatgttaccctaaatctaatacagcattccacagaagagatgatctttgattgaagtgagagcctggtaaaacctcaaaaacattctcaactaaaatgatctctatcatgctcaaatgtccctgcacataaagccacccacgaagcatattaaaaaaggcggttctgtaggctccactgcaacggactctgaaggagtacgtttaaagaatggttgaagaacatgtactttccacaatcacaccatatggatttgatgaaagtttaagcttctactgaaatagaattaaaatagaagaaaattaggtatccaaacttcactaactttaggcctctaaacacatagttttctagttcttaaagactttatatcgccttaagtacatttccttagatcctcttttcctgcttttaaattttgtttgcattccagttcaccttttattatgcacattatacatcgcttttcagtaaaacctgtcttgacccacccccgagtaaatttacctctcctctttcattgcatatgtaaaatctgcatttattctagcatctattgcactccagtgtcctttcgtttgcttcgttttgatccgtaagggcctgcagccttcttgagatcagggatcctgttcattttgtgttccctatcagtgacttgtcaaatatgtcgaacagatgtctgaacaaatcagcttacctgctaccaaaattgcctcacagagttaggctttattgttgggttcttaggccattaaacaaaaaaaatcctggtacacattttaaaggcatcccctatttaaaaaaagtgaccaacatatttctgcgcgttctttatgtaagaactcagttaataaacttcttttagaaaagctttgtccctcttaaggaattcatattattatgaattcacaactctgcctatccaggtttgaaccgtgtttccatcagttaccctctgagtgacctcaggcgatttgtttaggatatctgtgcttcagttttcttatcttttaaatggggctaagctgggcacattgtctagtgcctctgtaatcccagctactcaggaggctgaggtgggagaatcccttgagcccaggagctgaagaccagcttgggcaacacagggagaattggtctctaaaaaataaaattaaaaaagaaaacggggctataatcataagcacttcttgagctttgactaaattaatatatgaaaataacttataatagtaagaaaacattgtaaatgttgactattatttctttttaaaaattttgaggcttatatttctcacattatttttcttattcaggttttgaaaacatttgaaggtaatattaataccattcacagtaactgaccacatcagtatgtttgctttcttctgcttcttcctattttaatatgatgtttctgcactgcctggtttatggtatacctgtgagatgcccactgtatgccttgatcttttatttcaagttgtcttgaataacttgcagaacatctagagagcaaattattaataaatactaaatagccttggatattttaccttttaatgtatgtgcatatgatctttacatatatatatatatatatatatatatataaattttttcctgtctatattctcactcatcagatgtcactttttgcatttgtcaatatattctacctaacctctccaccctaatttgttgctgtgctttgggaaaaccaaataatcacatagccatcagctgtgtttatctcagaaaggacttttcgaagtctttaatcttagtgagtagcacaaatgacattttgcttgcattgttggataactttggtagctatcacctgatttaaatagatgggtttgacagataaataatattggatcataaatgagacattaaggctaactttattcatttgtagcagctgtttcctttcccaaagcaaagtccaagaaagtataaataacaggatttgaagatgataagcagcaataagcagtcactttggaaatgtcctcaacaggacataaatcaataagttaataaaaatatcatgtttcatggataacaggagcaggaaacatacattaaaaaaactttcaatacatcaaaaaagatgggatataactgaattcctagagatgaagagaaaaaccaacctctgatttcagtttcctgaagttttcgttggccgacttttaatcatttactccaggcacattgatattaacagtatcattgttgagttccctccccctccagtcctagactagctttagaaggggaccgtcccagcacaccttctcctcagaaccgagtggaagctttagttgatgtgcaaatgtgccacattgtttaacaagaaatgttggatttattaaaaaaaaaatgagtgaaactgaagcctctgggcaaaaggaactgggaaggaaactgaaaaagaaaaaaaggatggttgtgattaacaacaaaacaatttcacttaaaataatgaggaaagacatccattgtttagttagaaatagaagcccagattggctgagctaaggtggcaccaggaaagacagaattggagcttattttttcaattttctatttctgtatctaagaagttactttcctcgtaagtttgagtatggacacaactgtaatacagtgtatattggcatggttcctatacttccaggttgctcaaatccagggtcagttatgttcgtcatacaagcataagaaggtgaaattaaaacattttcctgggaaactgatatgtgaggaaatgttagaaataggattagagttaaacatttcacccatatttaccccacctatcctcctcaacagtccccaacatatttacaaagtctgtttttgcttcaaagaaggaggaatttagcaaattattattttgatgaatatatatttattccttctcatcaccccataattggttaagtcctgggcactgatccctttatttgttgctgcagaatccttccagatccttccttgggtctactagtctgcaattcctaataaagatgttattcatttatttttgtaaatatgtttgtatttgctcagacttctgggatcttatgattcctcaacgagtctttaaatataggaggtaatggcagtgagattgaatcagtagtttctgagtgcgctggggtaaacttcatcaagtctagattacctgtaagcatggagtttgactaagtagtctctcacctgttaagctgctgtttgcaattgctttgctgtcagtgttcaaatttatgtgaagcctgcaatcacacttaattcattttggggagaggaaagaaaatacaatttaagatctaacattctagatttcctctttcatatatttatttaaaaatatttgttaatttcctttaaagggaatgttgtatgcctatgcacagctatttttatacaacagaaagtgagaaagaattttgggtaagattaagagtgacaccattggagccaaatgtcatgggttcagaatcttagctttgccactttgtttgtgtaatcatgtttgctcattgtttttctgtttccccatttctaaaatgtggtcctagtggtatgtacctcacatctactttatagggtaattgcaataattaaatgaattaatgtatagagcagctggttagtgctatgtactattgtttaataaatagtgctatgtaactatttaattcttatttaaatgtcatacgatgtgtgtatatatgtatgtaaaatattatattctctatatacatacatatatacatacctacgtacagacatggcatttttttttcttgtgtgttgctccttatagtatatactgaaatatgtattatagatgttcaaaagataaactaaaatattttaaaagaatgagtatgactctcacaaaaatataaaaagaatacatgctgaatattttatttgacttactgattcatgagagaaccaataagacattaagactgattcaaagaaggattcaaaatacatacacatacatacatataggccatcagggatgattattaataaattgtcttactgatatacacatgtacgtaactaattatacatatgcttatatatgtaacaatcagctctttatctgcctatcattttgtctataattttatttccttagcattttgctaattattgtgtacattatatgtggtctctggatgcttataaaccttatttttaatttgtcctcactttcctttgtgtaatataaatttgagttttagtttcagagaacttatcgcttggccaggatgatttcctgcagtgtatttcattcattgtcatgattctgcttatgcatctaataatgcttctatttacaaatttacctattctcctttttttctccaatccttgaaatcttttctgttgtttcaccatgctaacatttgcattttccaaggacatttgcttttctttttgcaatttttcatcatctttatgtataaaaccctagtttttactcccctatttttagaatatgttaaaatgttaaattgtcttgttctttttgctttgtgtctttgcacagtgtacaccctaagcatttgttaaacccttctatcacatacccaatgtccatttacatttagctctaggaaaatttttctcactttaccaagtgtcttctcgaactttcatgcaaaatctacatcactgacacagaagacttttttgcttcgtactctacttctagtgatatttgaaagatatctcaccaagagttttattactcattatcattgctttaattatgtattcctataattcttttgtgaatgtgattaagtatcctcttttctcattattgttcctggtacaacttctaaaatctgcatcagctgattcctttctccatcattacaatttaaaatcacctcttgactgtgttcatcattcactgaaattatttcaaagtcccttccttggattaatgactccttcttgccttgttctgcgctctcctttctttgagagataaataggtaagtagcccattccataatcatcaactcgtgagattagaagataatactagaagttatttagagttgatccccttgattccagatggaagggaggatactgaaactttccgagtctgatggttatctcttcagaaggagatttgggaacatcttctgtgaataaatttatttctatgctgtgatgcagagttactaaaagtgaaggttcaattaacagctacaaattcaagtaagtttaaatcacattactgccaattatcctttgctggtacgtgccaaaggggaatattaaccagaaaattagcacattgaatgtttcattcatatacaaatcaaattcgagcaagatgtctcttccaaggagaaatagcaagacatgtatccttcgctatctttgtaggacaagagatttggtaaggtactagtttttagaaaaaacaaaacaaaacaactatgaaccttttaaataattttgtatttgttttgtgacattatttaattgttgtaaaggcagaatatttccagagttgacatttataagttttctacctacttcgttatctatcttgtaacacataataactttatttatttgtgacttattacatcaacaggaggacaatttcctttttaattttttctttcttttttggggggagtagtcttacactgaaattgagtggtagataaaaacaattcagggagaagcatcaaaagtttgcagtgtattaatcaatagtaagaaacattcttacagctttttcttacctttgacttttatctactctttttttctcttgctgaaatagctaatgtcccctattcatctatcaatgttttaaaactctattgaactatcaccttttccgggaagtgttctctcagtttgttttgacaaatctttctgcactgtcacccagtgtgtgggtttctcattgcactgtggttagaatggcttgtctatggatcaaactgcggtactcagctatgaagtcctttgttggtgggatgattcttgattatccctgcatctttgaggactaacactgcatcagacatttggtgaatagaaatttatttatatttgataagtagaattctgacccacagttttctgttattttggtcaaaataacattatcacattaaacaaaagcaatattgcataagtgatacagaggtttaacaaactcatagggcatatgcaatggagaaatcaaaacaaaagaacaatcaaaacaaaagcaacaacaaagagacaaaataaaacaaaaacaggaagagagaggcaagaataattaaaataagtgaatttgctaaaccctacatgaactgctacagatttggtaggtgtttgtgccaaagacatgaatcagctatctttagttttgtaaaattgatgtaggaaggacattatggggaggagacatcaagaattctcacaattcacaactctcctcaatggctactaaacctttcaaataacaggtagtgtggtggcaattgtggtgatagtggtggtcttaggggtgaaatttgattgcctgatgataattgaaagacagtccacctccctttttgaagcatcaatttctaagagatgattcatgaaagaccttcgtagagagtgagggattgaaatctgattgtctgctgaagcttggagcaaggggtggagggggagactgagttcaggaacagacttacagaatcaagaccatattcagattcaggcctagggtatagatacactgcttgaacagattctactgtttgctgaaagggtgcagcagtctagctgtcctggacccttattttgacaaccacaggaggcagggctgagacatgactggtaattctcttggcaatttcaagtgccttgccacagtcacccctcacaatggcaggttatgtgtttttgctaatacttttttctgtttttcccttgaatttcttcagatttcttaaatgcatttaatctgatcctggtactttgtcttctatctgttttacccattcaaactcttcttccctgtgacatttcataagaggtgaattttagcaatagaatgagtataaaatgacccttggaaactggaaccacaataataaaataactatctgaggttcactaagaataaatattcctgggaaagaaaaacaaactgcaataggaaaataagcaaacaacaaaaaactccaaatgagaaatgaatgtgaataaattactacctatggaagtgaaaataagatgaaattcaaaagctgaatttgaccctagtgtttgctccaactctaaaaacaagcatgaaattacaatcaatagaatagggaccagcattcctaaggcgggtattagaatccaacatgagaagaatgcagaggatgtaagaggcttaataagaatatcatcatggtgtttgaaggattccatcaatttggaatagtttacctgtgaacagatgattgagaaaaggcttctaggaacttaaaatctattctggaaaataaaacagttatagaatagtgccagaccatgggcaatgatttctaaattgtgaggtttagactaatgattgtgtgtcattttggagaacaagtcctatgagttggacaaagtatagatatttacttagaagaggttgaatttgggccgggcgcggttgctcatgcctgtaatcccagcacattgcgacgccgaggcagatggatcacgaggtcaggagttcaagaccagcctggccaagatggtgaaatcccgactctactaaaaatacaaaaattagccggttgtggtggtgggtgcctataatcccagctactcgggaggctgaggcagagaattgcttgaacccgggaggcggaggttgcagtgagccgagattgagccactgcactccagcctgggtgacagagcgagactccgtctcaaaaaaaaaaaaaaaagaagaggtggaatttaatctgactttttaagggttttacgatttagatgagcctggatactggggcatattgggatatttcacatgagaaataggaaaagcaaatttacatatatttaatttggcataatggatggccatgatgtagggtgttttccatgaaaactttttttggtattgtttaaatgccatcataggtaaaggcaagaataaaaaaattcgtttatgtctcacttgcttcactcttatttttatcaggattttggtgaccccgggtgaagaactatatttcacatgctattttatatttgtttgaaaataattattaataaaatacatagccataaaaatattcaaaattcatgtatagattattagctttttttaagtgaagtaagggtggtgttttaaacaattattaatatcttgacttattgtagattcttttttttaattaagaaactcaccagacactttaatactatgccctaactaggtcccttatgtctctgaattgcttgtactgtgagaggaatcacttaatacaagcttattagacaaccgagtagcttggaaatcccccgctagacctttcaataaggtttaatcaaccaggtaagaccctgatgaggctggcaattagacttactgtattttttaaatggagatgctgagtttcaaaatattaaaatgctgtttaaacacagtgatgacaaaattggaggtgctattgcagccacaaatccaaatccctgcccccaacccccaccgccacccttcaaccctgtgattcattacagcactttgttgaattaacaagtattaatttacctctgaattgctactaggaatttagcctgattcagtattgccatttgaatggagaaaatagttgcagtactaataggtattgcactggaaataattaaactgagtttttttaactctccatatctctgaactgaatgagcatttctactttagttttctcttaaaaaaatacacacatatacttatatatgtgtatatacaaatgtacaaatagaaatatatgtatatacgtgataatatatgggcatagtaaaaaaattcaaaatgtgtaagaggttatattattaaatatagtttatctcttcattcaccaggtttttaagttgctaatgtaaggacaaataaaaattgaagttagaagcttaattcccctcttaaaagcaagagaatgtctcccttaccttttcttagagcgtttactttaggaaacttgtaattatgtcatttcttggtctctgaaatgtatggaaaaattttttaaagctaaataagcttctgaccagctttacaatgcagaaatgtctttctcaaggaccaggaatcacctcttttaaatttaattattaagcaaaaaagcaccccacctcccagtttctgtgggagggtaggagcctaactccactgaacatctcactccaagttgcaaaactacctcttgtcataaagacgagtttacttctcaattggataaatccaattaagtcacacaaatgatcatcccaaatatcgagtgaatttaggatgaattacatgtgacaaatggtgctgtcaagtcctctaacttgaggacttggctatataaacgggtgaggtttccttctgtttttgcaatcccttagcagattttgtggaatgcacatcacattctggtttaatgctcattcgacgataaaattgtcttctttctcttctacctatatagcaagtttttctgggttggtaggagattttgtttttaatactatttcccccaacacaaaacagacaccactctggttcttaacagagaaaagggatgaattttaggtatctaagatacctaaaggattctccaagatgattggagagtctgaattggaaactaacataatatgaccattaaatctggacaggcaagctttgtagcttgaaatacaaagtgagaaatcgcctaaatgtagggataattttcaaacacattggacagccaaaaatatctagtatccactacatccttccagccctgtccctcgtctttattattctcaaatgtcactattattagttatgtaatacattcatgcaccatataacattgacataccacgtatatgagatggtccaataagattataatggagttgagaaatccctattgcctagtgatgtcctagctatcctaatatcttagcacaatgcagtcatcactcatgtatttgtggtgatgcttgtgtaaacaagccatttgcataaaaagtatagcacacacattatgtacagtacataatacttgataatgatactggtttatgtatttactatactatactttttattgttattttaaagtgcactctcctgagtattaaacaactgaactgtaaaatagtctcgggcagatccttcaggagtgctatagttttgatgtttgttctctcccaatctcaccttgaaaatttattcccaacgttggaggtggggcctaatgggaaacgtttgaattcgggtcatggggacgggtcacgggagtgagtgagttcgcagcctattagttcccatgagagttggttgttaaaaagagactgacagccaggcacggtggctcatgcctgtaatcccagcactttgggaggccgaggggggcggatcatgaggtcaagagatcgagaccattctagccaacatggtgaaccccgtctctactaaaagtacaaaaattagctgggtgtggttgcgctcacctgtagtcccagctactcgggaggctgaggcaggagaatggcttgaacccaggaggcggaggttgcagtgagccgagatcgcgccactgcactctagcctggcaacagagcgagactccatctcaaaaacaaacaaacaaaaaaaacaaacaaaaaaaagagactgaggcctccatacctcctctcgcttcctctctcaccatatgatctctgcacacaccagctccctttcgccttccactatgagtggaagcaggctgatgctgacgccatgcctcttgcacagcctgcagaaccacgagccaaataaacctcttttttataaatgacccagcctcaggtttttctttatagcaacacaaaacaaagacaaggaggtattccttaagaaggcgttagtatcctaggagatgacagctccatgcttcttgttgcccctgaagaccttccagtgggacaagatgtggaggtaaagacagtgatattgatgatcctgaccctgtgtaggcataggctaatttgtgtgtttgtgtctttgtttttaacaaagacatttaaaaagtgaaaaattaaaacaaaaaatttaaaaatagaaaaagcttatagaataagaatataaagaataaagaaagaaaatattttgtatagtggtacaatgtgtttgttttaagctttgttattacaggagtcaaaaaggtaaaacattaaaaagtttataaagtaaaaaagttacagtaagataagtttacttttttattaaagaaataaatttttgttttataaattaactatagcctaagtgtacagtgtttataaattctacagtagtgtacagtaatgtcctaggttttcacagtcactcaccactttcactgactcacccagagcaactttcagtcccacaagcttcattcatggcaagtgccctatacagctatactatttttgtcttttatactatatttttattgtaccttttctatggttagtcaggtttaggctatgcaaatacttaccattttgttccagttgctgatagtattcattatagtaacaggctgtacaggtttgtagcctaggagcaataggctataccacacagcctaggtgtgtagtaggctgtaccaactcagtccgtgtgagtacagcctatgatagtcacactatgaggaaaatggctaatgatgccgtactcagaatgtatccccatcattaaacagtgtttgactgtacatctagataaactacgctgtccgggtgcagtggctcacgcctgtaatcccagcactttgggaggccagggtgggtggatcacgaggacaggagatggagaccatcctggctaacatggtgaaaccccatctctactaaaaatacaaaaaattagccgggcgtggtggtggacgcctgtagtcctagctacttgggaggctgaggcaagagaatggcatgaacctgagaggcggagcttgcagtgagctgagattgtgccactgcactccagcctcggtgacagagcgagactccatcaaaaaaaaaaaaaaaaaaaaagataagctacgcacatgcaggcagacaatatgaaaaatacacattctgtcttgaatattgttttcttacatttttttattgaagaatgataaacatatataaaagtagacaaaatataaatgtacaatccaaagaactatcaaagctaacaccaacataatcacatcccaggtcaagaaatagaacatggccacatccccaaactactgccctggcgcctcttgcaataagtcacttctctctcctcgttcctgagttttaataccatagatcatttttttgtgtgtgcctatttctgaagtttatataactggaattatattcttttgtgtctggctattttggttcaaaattctgttggtgagattatgtttgtgagtatagctgtctgtagtgcattttattgctctatggtatttcattaacgtcagtgtccccctggtaatttgctcacttcaatgtggatgatttctgttttcagtttgaggctataatacattaagctgctatgaatattttgaaagtgtctttaggtgcatacgtccatgcagtgctgttcagtagatgctaggagtggaatagctgggttatacatcaactttagtaagtactgtttttgcaaagtgattgtaccaatttgcatacccatgagccctggatgagagttcctattattacttaacatgctcaaccaaaacgtagttgtaagtctttcataattttagcccttataatgcatggttaatagtgtctcattgagattttatttcaaatttgccagattaataatgagggtgagtaccttccacattagtagttatttgtatccctttctgtgaaaggatattctttttgcccattttatgattgagttatgtgtcatttcttattgatttgaagggattatttattctagatacaaataatttgctgtttatatgtgttgcaagtgtcttttcttgttacatggtttcatttatattctcagtgatgtcttctgataagtagaattttaaaatgttactgtatttgaattattaatcttttatgggtatatctatgtatttatacacacactcatttaggatttaagatttgtaaacttcttttctttctgcctttgttttagaaacagggtcttgctctgttgccctggctggagtgcaatggtatgatcatagctcacagtagccttgaactcctgggcccaagccatcctcctacctcagcaaccagagtagctgggattacaggcgaatgccaccacacctgggtaatttctttttctttttcttcttgtttttattagagataggatcatgctatgttgcccaagctggtcttgaacttctggcctccagcagtcctcctgcctgagcctcccaagtagctgggattacaggcatgagccaccagtcctggcagatttgttaatttctttgaattattatatatttttaagtttacttccatgtatttgactttttgtgtgcttataactggtatctttttaaaatttcattttgtaattgttgttgctggtgtatagaaataaaaacaattttcatatattgaccttgtcaccagcaaattttctatatttacttattagttgtaatgtgttatctgtagattctgttagattatttgcattcattagcattgattatgtaatggtatacattggagctcatttcatcttagtaaacacaaagttggataattctttttaatggctagtgagtatttatatactacaggtcagtggcatggttagtatggagactgtagggtcagacttctgggtttgacttatggttccaccagttattatctgagtgaccctattaatgtcacccacgtccctatgcttcactttccttcaaggaagactcatgcatatgtgttgctcttaccaacactgtttcagtgaatgctcttgagtatgttccttgtttatatgttgtgtataaatgggtgtgaagttctatattcagatatttctctgaaatggttgtactaatttacactcgtatcagctgtttgtaagagttcatattgcctcacatttttgtcagcacttggtaatgtcaacctatgaagggttttgaatcaaaaagattttgaaaatcttgtcaaacttaaacattggcaaattaaaaaaataataaaacaatgtttcacttttacgagactgacgcattgctggctgtgctaagaggtctacatagctcattaattttataattagcacttttatggttactaatgagttttggaaactttccatatccttgatagacattttgctttctgtgaattggctattcattttttgcctttttttttttttttttttttttgagacagagtctcactgtgtcacccaggctggagtgctatggcacgatctcggctcactgcaacctctgcctcctgggttcaggcaattctcctgcttcggcctcccaagtagctaaggctacaggggcctgccaccacgcctggctaatttattttgtatttttagtagagatggggtttcactatgttggccaggttggtctcgatctcctgacctggtgatccgcctgcctcggcctcccaaagtgctgggattacaggcatgagccactgtgcctggccattttttcttatcaattcaaaggaattccttcaacgtattgattacttattcttttttggttacatagatcgtaaatgtctttttcagtttgtcatttcttcttcttctttttttttgatggggtctcactctgtcacccaggctggagtgcagtggcgttatcttggctcactgcagcctccacctttcaggcttaggtgctgatcctcccacctcagcctcctgagtagctgggaccaccaaaaatacaattttttttgtattttttgtagagacggggtttcaccatgttgcccaggctggtcttgaacccctggactcaaatgatccacccatctcagccacccaaagtgccgggattacaggtatgagccactgcatctggcccagcttatcatttctttcctactttgtgtatgctgaactttgttgtacagaaattgcttaatattgtgtattatgtttcgttcattttcctcttgtataaaaaatcccttctcatcttaaaatcaaaagataatcttgcatactctattctcaaaacttttacagaaatgcttttcacatatgtatctttaatgtacctggagtttgcttttgtgtatggtttgaagtacggacttaatttcattctgtttattttccatatgaataaccaattgtcccagaacaatgtattgaaaaagtcttcattttcccactgatttgcaagcactctatcttagatcaggtttccacaaatgcatggctacacttcggagcactttccgttccttcttatttatccttgcacaaattccacattattactagtaggattttgtaatacagttcttaggtatcaacccccctctctctccactattattcttctttaggaatatcttggctctttttggaccttgaagttttcattactataattgtattagtcagggttctctagagggacagaactaacaggctagatgtatatatgagggggagtttattaaggagtattgactcacacgatcacaaggtgaagtcccacaataggccgtctgcaagctgaggaggaaggaagccagtccgagtccccaaacctcaaaagtagagaagccaacagtgcagccttcagtctgtggccaaaggcctgagagcccctggcaaatcactggtgtaggtccaagagtgcaaaagctgaagaacttggagtctgatgttcaagggccaggagcattcagcgctggagaaagatgaagtctggaaaactcagcaagtctgctctttcaacgtctgcctgctttattctagccacgctggcagctgattagatgacgccctccaagattgagggtgggtctgtccctcacagcccactgaatcaaatgtcaatctcctttggcaacaccctcacagacacacccaggagcaatactttgcatccttcaatccaatcaagttgacactcagtattaaccatcacaattacattttagaattttaataggattgtgctagtgggttgtctctgattagctgtctctcagaacaattgtccttccccacctgggaccccgtcctccttgctgctttaaaatgcaaccctggggcgagtctaagggaatagaggggcttcaccccatggtgggaatgggaaagaacgtctgctggggacatgtactgcaatttgtctcaggcaatctggccaagggaaaagggatccactcacatccactgacagactccaagatgcactttccaaaggggcatcccccctattagaaaggatctctcggtgttagaaccttacactgaatgaacagtgggtgagcaaccccaggtcagttcaggtatgaattatgttgagtgaccaatccaggtacgaggataaaaggttgcgggaagactcactgtcctggtgcagtttgagatcacctgacttaagacatccagagcatggtggctggctgtcttcataggagaatttagagtgagaaagatggggtctgagttccccagaacatgtgtggatttgtcctgtttgagcttctgcctccagatgcatcacatgtagggactggggacttttgaccagaataaggaggagagaaccttcctcctttccggggaaggcagccaaacctgttcatcccctggccatcaggctacaccagggagtggccctggcccattgccttcagttgccagagggatactagagattgtccactggacaactgaaaggaaaactctaaactctcacccaatcaggtggtggcagtcagctgtctttccactaggacattctggcccgctggggagtagcccctgtccgggaccatcagttgtctccagacttggacgctgtccgctgagaggttgcagttggaaaagaggaaatgggaagagtacgggagagagtacgtggctggctggggccggcgttgcagggggtaaaagaatttactgacacagttgtgggtaaagaaaggtagatttattagagaaagtacaaagatacatccaagggtgcaacaggcagcacagcagcgaaggggctgtctgctaaaagcggcaggggctggagggtggtgctgaggagctgtgtgtagaacgaggttgtgctgctgggcctatgtgtggagcaaggtatttgggaacaggattgttgtacgagtgggtggttgtgattagctgtctcttagagcaattgttctttccaacctcgggcacgtcctccttggttacttattttatcaggactccacgattaccacaaatggtccctcaagctactttgtagtgatctcctcaacactctgccctgggaaccaccccatttcaatcaccatgatttagttttgtctgttctaggacttcacgtaatggagtatggtatggtttcgtttgcatctggcttcttttttaacttttaagttcaggggtacatgtgcaggtttgttacataggtaaatgtgtgtcatgggatttgttattcagattattttatcctattaagactagtatccactagttatttttcctgattgtctccctcttcccactttccacccttttctctctctctctctctctctctctctctcttttttgacacagagtcttgctctgttgcccaagctggggtgcagtggctcaatcttcgctcactgcaacctccaccttccggtggaggttgaggcacaagcgattcttgtgcctcagcctcctgagtacctgggattacagacacatgccaccatgcctggctaatttttgtatttttagtagagagggggtttcaccacgttggccaggctggtcttgaactcctgatctcaggtggcccacccacctcggcctcccaaagtgttgggattacaggcgtgagccactgcccctggcctccaccctcccctttagctcagcatactagttttgttcattcatgttctatgcatcagtagtttgttacttttattcccaagtagcattctactgtatgcgcatacgcaacttttatccattcttcagtttatggtcacttgggatgtttttagttctgggctgttacgagtaaaactgctatgaacatttgtatacatgtcttttttttttttttttttttttgaaacagagtttcgctcctgtcacccaggttagagtgcaatggcacaatctcggctcactgcaacctctgcctcccgggttcaagcgattctcttgcctcagcctccagagtagctgggattacaggcatgcaccaccacgcctggctaattttttgtatttttagtagagatggggtttctccatgttggtcaagctggtctcgaactcccaacctcaggtgatccgcctgcctcgacctcccaaagtgctgggattaccggtgtgagccaccacgccccgtcctacatgtcttttttttgtatacaaatgttttcacttctcttgggtaacaccaagaaatggaatagcaagatcttatccaagtgtatgtttaaatttacaagaaattgccaaagtgtttctccaacagttatagcctttaacatacccacacacaaaatataagaattccagtttcctcacatctttttatttttagccattcaagtgggtgtgtagtggtactcaaatatggttttaattgcattcattgaataaagaaagatgtgtgtgttttcatgtgctgatttgttattcatatagcttctttggtgaagtgtttgtataaatcctttgcccgtttttaattggattgcttgtcttcctattattgcgttgtaagaattcttatatgcttggttcaagaccttgcttaaatacataaatatcttttccaatatgcgtcttgtttttcacttactaaagggcatattttgaaaagtagaagtttaaaagttaatgaagtgaaatttattactattttccttttctggttggtgctctttgtattttttagaagacatgattgcctgacccaaagttgcaatgagtttttcactttttaaaagacattttatagctttggcttttatatttgtctctgattcatttaaaattaattcttaggtgtggtgagattcaattaaggtttaactaaaaaatattcttcagttgttccagcagcagtcgctgaaaaagctacccttttcctattaaattctcttagcagcattgttgagagtcaatgatgctttatgtgagggtccctcacataaacgatgctttatttgaatgccctgtcctgctccattgacctatattgtctatccttatgctagtactgtattatcttgatagtggtaatttgtttttttctcttttttttcttggttgtcctggctaaggcttatcaggtttgctgatctttctaaatagtaaacctttaattgtttcattgatttttttctattgtttgcccattttctatttcattgatttctgctcttactgcttccttcctctacctattttagaattaatttgttctttcatttctagatatttgtgtgtgtgtgtcttttgactttggtctttcttgttttctaaaataaagcacttaagactgtaaatttccctttaagtcctgatttagctgcattttacaggtttggcagtgtgtttttatatttcaaaatattttctaatgttccttcttatgatttgttctttggcccataattatttaaaggtatgctgcttaacttccaaatgttttctatatatttttgaaaagaaattgtctaattgtttgctttagcttaacttccaaatgtttctatatatttttgaaaagaaattgtctaattgtttgctttatatatatttgtgtatatataattatctcatcagttatttatgttcaaatatttcataatttttaaaagaattatagaaagaaatatcatgaaatatcctttcaactacgatgttgaattttctgttcaccttgtaattctttcatatttttctcatgtattttgaggttatagtatctacctgctgattgagaaaaaaaagttatcattgcataataactatatttcttcctcttaattattgtgtactacaatgtattaggtctgattaatatctccataccagatttcatttagttaatatttacctggcatatattgtttcacattactagtctaaaaaaacgcactcaatctctgcttttaaatttagtccaatttatgtatttatattcattgtaaatgctagtatgtttgcatttatttttaatatttaattttgatttgcatccacccaactgttttctctgtttcttttttttttcattttcttccctatttagtattggaatacacaataccaaagaaagcttacttctttagaaattgtattttctgtttttctgttagaggttaaccataaaattgttgcatgtctatttgccttaaaaatttctaacattaatgtatatgtctaccctccctatattaaaagagttttaactgcattacctctgaaaacttctttcttgtctcacaggtaattgatataatataattgaatttgtctttttctatgtttacaaaaaacccattattaataatttttgtttatactgctgctgctgttatatagttaatacttgttaaagtcttatctaccacttcagtaacttctttgctcaccattcctttctgtatttcagacgttctttataaggttcaaattccttatacctgaaatatatgctttattacaaagaattctttttttttcttttttttgagactgggtctttctctgtcacccaagctggagtgcagtggcaacatcttggctcactgcagcctccacctgggctcaagtaattcttccacctcagcctcccgaatagttgggaccacaggcgtgcaccaccatgcctggctaatttttgtattttttgtagagaaggggttttgtcatgttgcccaggctgatctcgaactcctaagctcagacgatctgcccgcctcagcctcccaaagtgctaggattacaagcgtgagccaccacactgggctggaattcttttatggataagcaccagtcttttatttttattttttctctcttagtttgaaaatacagcccttttgcttagctgggtatagatatcgaactgaacttttctttctcagtacattcattgtctttatattttgttttagctctttagtagtctgcccttaatctaaaaatcagtcctttgaaagtagtttgccttacctattaaggtcctctgttttactgtttttcttcttctggttaatgtttacctaattatctgtggatctaaaaaattttactttttatgggatattttgtactactgaatctaagaattatatattttttctatgtaaggaaaattctccaagataatacttttaaatataagtttttcctcattctttttcagtttaaaaactttatattagccatacattctatttcctattttaacttacatattgtactctcatatattccatgtctgtttatattttctgcaaattgtaagtgatttttctctgattaatattcaaatttactgattttctttacagctttatttaattgactagttcactcagtttttgactgcaattactaaatatcttttaatattcaaatttctactttatttacatgtatctttatttttatagtctactaatctgggatttttatgtgtttgattaattcttttatattttactcattttggagtcactgtattatctctatataatcagatagtctatatctgatagttctactgtctgtacttgaatatttctttctactagttttggatcagctggttgaattctagttttccatattcacactcatgttgtgttgaagtctgaagagggagtttaagagagagcttttttttttgttttggtttggttttgttgtgtttcagtctgtgctttttggttgctacaggtatctcagcacctcaggctgcatttgctgttgatgtcttgaggtaggaattcccagatcatacttgaaatttaagctgcaggcccattgtgcttgtaagtttccaggagatttttttggaccaaagcccaggctaaaataggcaaacaatgtttgtgggcatcctctatcagtgggaatatttttttctctttcactcttttattgtgttttcatctaaatgatatgtgtggttggccaggtgcagtggctcaagcctttaatcccagcactttgagaagctgaggcaagaggattgcaagagaagctgaggccaggaggtctaggcttcaatgagctgtgattgcaccactgcactccagcctgggcaacagagtgaggccccatttttctccaaaaagaagaatagtatatgtggaattcttcacaacaattccccaaggcttttttgcctgtccccacgtgtggttttcttggttattgagatgagcagaatccctcagccagttgcagcttcaattcatgggcataaccatgtttgtccctcatgattttctttatacttttctgttcagttatttattgatagatatcccacacataaacacatacactcatcactatttgtatacatttctaaaggttttattctgggagacttttcaagcgctcactcaaggcttctttctactgacagaggaagagaaatgaagagtgaagcttctctgcttgtttgtgggattctagtgttcctcctgatacagaacaggggctcctggctaaaccccaccctcaagcctggaactttggcgctaggtgaaaacagctgaccccatttttcctcccaaatgattacctttttggcctgccccgtcctatatcctgtgcccttaaaaaccagaccagttggcagaaacaaacaagaaaaagagcaatagaagcggctaatgtaagagtttggggatgcaagctgctgaacggtggggatacacactgctgagcatcggaggctatggatacactgggttatcttcagatggtgcggcttcagggaaagatcaccttctgcaccatctcctttccaattccccatccttctgagacccacttttaacacccagtgaaatcctccacatatactagccttcaaatagtttgtgtgacctgattctttccagacaccaaacaagaactcgggtgtcaaaaagtgtaggtgcaactggctgtcaccctgacccttcactgagctgttaacacttatttgtccatggactggaggctgagtgaaacgagccattccagttcctgcccacgaagggggtcaaggtcaagggaacaatcccgtctccctcccagaatggatggatgggattttaccattttgtttggagctgccatctcctaggctagctgtttcttgcaagggaatcaagcttgtaatccttttgtgattctccctcaggaagacccagtgtgaatagtgttacatttataatccataaagagagaagtaacagctctgtggatcaaaaagcctgggttctctgggcaatttgtgaatgtcctggtcaaataaagtcacttcagtaacttgtgagaaggaccaatagaacagataagacagcacacccagcacctcatctaacatttgagtaagagaaaagggctgaaccacaaaataattattttgctatacacttcttccttagatgtgcgtctggtgtcttggagagacttctgttatattacacagtatggttactctgattcacacgccctgaatcaggttcttttcgttatttttctcttttttttttttttgagatggagtcttgctctgtcgcccaggctggatgcagtggcacgatctcggctcactgcaagctccgcctcccaggttcacgccattctcctgcctcagcctcccgagtagctgagactacaggcgcccgccaccacgcccggctaattttttgtatttttagtagagacggggtttcaccgtgttagccaggatggtagttgtttttctctttaaggttcctagagtggtggttcttacaaaccacactccctttgcactaagtcaaaatgtgtattagttgctgcgtttagaagttattagatatcttcctgcattcacagaatcatttttaagttacaatattcagttaacaatattatttttccatttgaaaagtctaataatattattcaatggggcccttcctgttataagaaaatagctgtcttatgtgtagacttcagtaacaagatgttcccacatataaggacgatgtgtaaatgtgtggcttagcttatgtaagaggggagccatcaacgtttggtattctaggttatgtcaatctaaagatacttgggtgatggagaaataggaaaaaaaaaagctcaatttatttttcctctttatatcaatagcagcaggtgcccttttcaatcaacctagaaggctttgatttcatatggaaatatccataagtgaaggtgtaaaatgagttaggtactggagtatgaacattttgtcaagaagacaaactgtgttaatgctcatctctacatttattcattttagatagattcattttatgtgtcaggcacatagccattctattaggcacaaaatgtacaaacatgagtaatctggctctttcctcaaggaactcatggtttgataagagaatacacacacacactgtctattatctatctatccatctatttattacctatgtatttatctatcactctctcacacacacaataatcaggaaaaaatttacaggtgattgagcttaatggagtttgtcagtcaggcaaggaaggaaaaagcattccaggaagagggaacaatattaatatagtgggagatgtagccagtgaaaataaaagtaatattcagagacactgaggtaatttgaaatttctgaagtgtagagtgcataaggaagagtagtggaaattcaaactagggcaagtagaggattaacccataaagggccttggatgatatgctatagaactgttgactttaatcttccaaataaccgagcttctcaataatatgaatgagagagaccatataacaccacttgaattcatctcacttgtccttcactctatctcagacatgtactttcaagagtggtactggacctgctcaataattagcacccctataaaagtcaaactttcatgtattcttacctcacttcctataaagacagcttactcttagtccagaaatcttccattgccactctaatcctttactccactggtgttatttaattggcccttacctgatttgattatgtcctcattgccctccttactcagaatgaagctcataatcaatcactcttataatagctttgcatatattttcaaccttgttttcaactttcttgcttgcactaggttggaaaacctacaatctggttaaattcagttttctacctaattctatgactggtatcaccttcaagttgtgatggtgaacctcaagtggactgcttggaatcacactgtatatatccacaggctattctccaaaggagatcatttccaaatttattttattttgtttgtttttaaacttttagattcagaggtacatgtgatggtttgttacataggtgaactcatgccatgggggtttgttgtacagattatttcatcactcaggtattacatccaatacaaacagttaattttctgcttttctccctcctcccaccctccaccctcaggtagatcgcagtgtctgttgttcccttctttgtgttcatgagttctcatcattgagttcccacttacaagcgagaacatgtggtatttggtgttctattcttgtgttagtttgctaaggataatagcctctagtgccatccatgttcccaaaaaagaaataatttacttctttcttaaaataattttaatgtttattaaaacaagctgttttatgtttttgtgtgggtataatggatctacttcttttttatggctgcataggattccatggcatatatgtaccacattttctgtatccaatctgtcattgacagacattagggttgattccatgtctttgctattgtgactggtgctgcagtgaacatttgcatgcaagtgtctttatggtagaatgatttatattcctctgggtatatacctagtaacgggattgctgggtggaatggcagttctacttttagctctttgaggaatcaccataccactttcctcaccagcatctattatttcttgactttttattttatgatttttttaaggcagtgtctcactctgttgtcgagtctggagtgcagtggcatgatcttggctcactgcaccctccgccttctgggttcaagcaattctcatgcctcagcctactgagtagctgggattacaggcattcaccaccatgtccagctaattttttatatttttagtagagacggggtttcgcaatgttggctgggctggtttggaactcctggcctcaagtgatctacccgcctctgcctcccaaagtgctgggattacaggcgtaagtcactgcacctggactattttttgacattttagtagtagccattctgactggtgtgagatggcatctcattgtgatttgatttgtatttctctaatgatcagtgatgtggggctttaattcatatgcttgttggccacatgtatgtcttcttttgagaagtgtctgttcataagtagaccctttcagaccttggctgatcattttcataccccaatgcctcctcctccttccccactctcagcttggttttttcctcactgaaaaattgaagcaatcaagagatgtcttccacagactctcactgctcactctctgtcttccatacatgcaaactctgcttttctgcatgttactgtggatggactttctgtgataccgtctaaaaccaatcaacgtctctactttgcttgtccataccatgccatttctttgttccttgtagtagttaacttcctatgtctaagtcttcttctcccattattttagaaataatacttttatcaattttttcccctcacttctccatcaaaattgctcctaaagctcactaatgacttcatgttggtgccacccttgttggtaggagatataatcatcttatctgacttggtagcagcactggcaaaatgaatattcattttcccttaatacactagattttcacatggactaaaacaaacagatgtcctttctttccctcccacttcgctgaacttcttgggttcctttgcaggtaaaatagagaatgaattatttttcttatatgaaagacataaactgcatatttgtgtgtcatgagaataagccattccggagttaaaagtaatgatacaagaaagtgggaagattaattttctatgtcaactggactgaattaaggtatatccaggtagctggtaagaggttgcttctgggtatgtctgtcattgagggtgctgtaagaagagattacctttggaatattaagaagactgagtatagaagatctgacctcatcattgtgggcaggcattatcccacttcttatgggcccaaatacaacaaaaatgtggaagaaaggcaaaatttctctctctcctttagctgagatatttatctaatttttcccttagactttggagctcctggtttttgggccttcagactttggaacttacacaagtccttcccactcccggcatgggttccctgattttcagacctttatactcagactgaatcacaccaccaacttttctgggtttccagcttgcaaacagcatatcatgaaacctcttggccctcataatcatgtgagccaattcccataataaacttcctcatatatttatacatatcttaatggttctgtttctctggagaaccctgactaatacagaaagcaaagaaataataattttccgcaatgtctatgagcataccaagaggggatgagattcaggacaaattgaggaattggttttggataagaccatggcaaattcatctaagttaacaggtggaagagtaggttaggcaggtgcagattggagtaagtagtagatgtggtggtgagactgttaaatgtcaccttacggtggctccagttttctatgtgagtgtgagtaaattcattaactaaaggtgtgggtgggaggcatgaaggaagaggtttgggatatgagcaggtatgtgaaataatgaatcagtatttctgtcaactttagagagacctgctgaaatccccaaattcactgtgattctccaggaagttaccagggcctgagctaatgacatggccaacagcaagcctgcaagatgaaagcagtttattaatactcataccattgaggattccaggaaggaaagcagactcaccagctggaggtgggtggtccagaacaacaggggaagtggcaggaaacaaaagggaaagaatgtatgcattaattagggagggacatttatttgtttatttgtttgttacttttcattattttgagactaagatcgagattatttttctagttgtgtaatcgcaaccttaataaaaataaaagattgatgcctttgatatttttcttccaaataaatagatacaaaaaaacaccaaaaccaaatacttgtaaccttagtctgggttcagcattctcccagctcttcatgggagtttctataccctcccaaataaaacttcgccaaagaaaacctcacaacatctagcaacagtatctttatgccttcatttcctactataatgtaaattcctgctagtacatttcctactagtcaccatacgattggattttggtcccaatcagtacttgcagatatcaccaaaaagggaatctgcttttctttttgtatcacagcctctgatgagggccatttatcaacctaacccatatgagttatgggtgttggttaaggagaaaacgaactggggagaggcaagtggtaaacgttgctggggcatccctggagctgacaagcagttgtcacttagacattacaaactggtgagtccttctcatttgagtcacctggggttgtggaagaacaaacctacatttatgtctgtacccagtagaatttaagctccttgaggatgagcttctttgcctatctttttgaaggaccagaatccagtataatgcttggtactatttggcgttcaataaatatttgttggaaaatcaattgcacatataaaacattattctcatagagtttgtagggattgcagaattggtatgccaaacaaacaaactggtatcaaagtaactgaaatgcttacatttttcaaacactgtaatattaaccaagactcttgtttttgaggacccttgtttttgaatataaactcatgtcaaagtgttttatagaaaagtgttttactctttgtcattttcttgccataactgagaaatccaagaggtgaatgaatgtcagttatggctggatctaaggcctcatggtgccactacagcttgatgccctctccctttctggctctgcttaccctgcctggattgactctcagaagagccatctctatgtggtggtgtgagtgagggctgcttcaagtcccatgttgccatcttcctttctacctttgatcccaaatctgagccacttcttggaatttgggtaaagagattaaattaaagaggaaaatgcatcatctgcattagtggattgagagagggcaattctgtgagcatctagagatgaattctttctgttctctcaaggatttaaaggattcaaattcctccagtgcacatgctctttccttttacagggatgacttccatattgtgtgtggaacgcttacttagtgttcaaaacgctgtccagctttcactttctctgtgaaattgtctgcatcagtctgggtttactgagaaaaagttcactacaagtattagagaaatagaagattttatctaggaatctacatataggatttaatgtaggaatgagaatttacctgaatgtggtaggatctggaagactgagagattagagtctgggagattggagaaatactcaatatgatgtcagcctggaggaagctgcagatcctgtagcccacccagcaggagtttgtggaaggctctggaaacctgctgcatcagacagtataaaatgccaagcttcatggtttctgctttccctcttcccagtcttctaggagttcgtttcagtgacaaaatctaacctggcacttttcaagacaagtggtttctgagaaatgtagtttccagcttacaaagaactgatagtgatgtcaccaaactgacagctgtcagtcccaaagcactgccatggtggtgagctgcctccaacccctcagccaatccctacaaccatggctgaggctgggcttcctctgctgtagccccgtggttacgtgggggcttccttccacttccttctgtgtactccataaaccgttctgttatttcatcttttatattctattataattatttatttacataaatgtcttcctctcagagttgtgactatagaaactactttcttactcatgttcatgtcttcagaatctgccgtgtagtagacccataaacactttctgttgagctaaaatactgtaataaaaatatttcaaaaatcagaaagaaaggagcagatgtctatagataacagttaaacaaaggcatgtggatgcccttgccagatgctgcgaggttttctttggcgaagttttatttgggatgttatgaagacccccatgaagagctgggagaatgctgaacccagactaaggttacaagtatttggttttgttgttgttgttgttttgtatctatttattttgaagaaaaatatcaaaggcatcaatcttttatttttattaaggttgcaattacacaactaggaaaatctcaatcttagtctcaaaataatgtaaactaacaaacaaataaacaacaataacactgtgttcttacctgaaagaatattgctttcttagtactgagatcgttaaacttaattcccgagaaaaacaaaggtggctgacttgtctttaggtatttgttcagcattatgtgttttactcaaaccagttgggtcatccacaggatatcctacatgcccttaaaacttcacttatttaaggataggacagattaacagtttgacctatctttaattctgttttgcaaaagctatttaaaatacatccgataacacatgtattttaatgccaaaaatcctgtgccactttcctttgaatgagtctctttgtcttggagtatttatcctttttgatactgcattgttttagaattcagagtgtcgagtttaattctgaattctgtcagtaacttggcaaactttgtccaagtcacttttctacctagtgcatgagtataaaaataggcatctaatctcattctatcagaaaacctacagtaatgttttcaaagcactttgtattcctaaggcaaaactctctatataaacccagtttccttctttctaaaagtgaattgaaagttaaaaaaaaagctcaagtatctgatgaaaattcttttccctgcataaataattaaaatggcattttgcatgagatactctggggtccactgaataagccattaactcgttgtttaatgtttgctcccacaggtgccttaagagcaatactggcagcatgctgaagtatttttcctacttatttttagctattgctttccttttaatttttcatatatcatgtgtaaaataacaggtcattagtaaaaacagaaaaaaaactagaggaatattttccccattcttttgagaaatttggagttaattgctcatattttgtatttcactatgaacagaaatcttgccccctgtatggcatagactacaaggatttaaatcatatcatatgataatactcttgctttaaaaccattctggaagcatatgcatttgcaggaggctggccactacaaaattaagacaaagaagaggaaatttttaggtctcttacctcagctagggaaaaaaaaaacaacttagaacataatccaagtaaatgctatttgcctactttaaatccctaccacgtgcttggtataatgcacaaaatattttgggtgaagggaggttgaagaaggaagagtaacatttcaaaaatgtgaagttaaaaagaaattaaagatcgtccttctagttcactttcaatattgttcacggttcacttcttttttgatctaatttgaaatttcaatctatcgtttccttcacatttatacaatataatggtcccttgtcttaatactttctttcatatacccttaggattctaagatgcatcaccccagccattcttttctctgtatgctaaacctcctgctccacttcatctatctggcaaaatcccaaatcttgcagacatccaagtagaactgcctgatttattctcaccccaaagtaggccactatataagaagactccactttagagactatgaatgccccccaccccacacccagtgctttcgtaaaaggtctatgtttcttgtcagggcttataggactaggggcgttctatttgcaaaacttggctgcttggcagtttcctaaaacattctaaagatacagtagatcttagaaataagttctagcattctatagctctgtaggattcctacagttaacaataatatattactatagttgacaataatatctgctatatagataatatataatagtaatatattaataatactatagttaacaatatactatagttaacaataatatagtttcaaatagctagaaggagaatattgaatgtttccaacacaaataaatgataaatctttgagatgatgtatatgctaattaccctaatttgatcactatccattatatatatggaaacatcaccatgtatcccataaacaggtataattattatgtgtcaattaaaaaataaaataagtagacaaagaagcattagaatgcaaacaataaaaataaaatgatatactccaatatacccaggtctattttcccctggatatttagccattctgcccacaggcccattgctcttctcttctacatgatgaaaagccattctgctccattcaccatctgtcttcaacttgctgaccaaaacccatctcagtgctcagcaaccaaaatgccattcagcctacaaacccagcctctttagaatccattcagaagcgatcctttgttacacgatcatgtccttggttattaggcggtggatggggttaactttgcccttgaagtagcttatcaacatatttctttcaaaaagttctcttccccagaataattctggtgaatatatatatatatatatatatattttcactgtctgattccactgttctctcttccattctgacaagtgttgtgtgtggcaagttatgtgatcgaactgattacgttcaattcaaattcatattattcaagactaattggatcctcactgctgctccacaaatctctttacttctctttagcttttgaattctgaacagtagctgtcctaaactattttattcccatcaagacctgacttccctctcattacatgactttctcttctattttaataaaattaccaagactctttaatgtaagctccctgtgctatgccttagaatgtcctcgtattttctgcccttttctgtttcagaggaaaaatcatcaattcttactttgaagattattgttagtgtggtaacagtgtagcagtccatctgtttgatgaatctcaagattcctacaattttactctgaattgtgaagagagtaaattatcagagttgatcttaggtttcctgttttctttgttgcattctcatctctctattccgtcttcctaatttgcttcctgcacttcctgggtttaatgccttcatatttctttttttttccttctgtgctcccaacttccactttcaggctcacaacctcaaaatgctgaaatcctacttaccctagagttccatccctttagctagctctctagctcatcacattctttgcagatttgtctatctctttatatttttacctccttatctggaggaattttttctgcctctaccacataccactgagtgttaaggttatcactagggataaaaatatgtgaatgaactatatttcccatttacaaggagtcctatttggaataaatcattttttaacgagaaaatggaaatgaggaaactaatgattaatgaggcatgctggtctcaggtgcttcattgagctgatcttccattctcatttgatcagtaggtcacattctgattacctgaaatttcccctgataatttcttaactggaagagtaaggctactttcttgtgaattggtaatgccaataatatttattcaggataaatattgaaaatgtattatttttataagttaagctaacatattttcaaagttttggttttgtacagttttgttggtcaccatctgtatgcacaatatgcattagactagctctatcacaaactagtaacattcagtatagaaaaattctacttcttccttttgcatcccagacaaccacctggacccaagaatcttcatgcctctgacctggctcctatagtactttacctgggtctgaatgggctttagttttatttgtttgtagttttgttttaaactgcagagtagacagttctcttaacttctacttattagcatataaccctaataaggttatatgcttgtattctgacaaaattttccatgtggctatattattatgtaagtttttacagttatcataacatgctaagtgggtaatatccaagatataacatgttaatatcgttaatgaatcaatttagacatgttggcagacacataagaataatattgttggacatgtcagtttttcaacatctctaaaagcatatcactgattaaaccatagtttcttagcctagtagatctttagatcacaaagttactcacagatgaccttcagaggaccaggtgttcgtgaaaccattcaaagagtttgcaacaatttctttatgcatgtttacatatatatatatatatatatatatatatatatatatatacacacacacacatatatatgtatgtatggtttagaaagagggtctataactttacttatatttttcagtgggatatcagacctttcaaaatgttaaaaacctttgacttttactaacttcaaaacacttttgaatggagtaaacaaatgtgattcacaatcttttgatttatttgtttatttcttaaaagattttttatgtgaaatttacaacttcagtttttcaagaatatatttttaaaatatatttgaattctaaaattatattcacttacttctaaggtagaatacaaaattgaactaatacaaaattgaactaagcatctgacatatccaccccaggaatttgaatatagattgcttcataatatcgcctaaggtattgtatctaatggtaaaatggcagaatagaagatattgttaattttaacaaaattaactttgtgctttgtgagtgttttatatttctttatatatttgccccaggatatttctagatgaaacaaattacctcatctgcagtcaagaaggatggactctgagcatcacctggcagtcctattggttgagattaaatagctcagcagtgtttctgaaaaacattagatgctcccttgggcacattttgaatttctactttttgatttttaaaatatatgtaaacataagcatgttgattataaaaatacctctgaactcatcttaatgttactgcatataaattatttttaaatcaggtgttcaaaacatttactggccagagacagtgcttgtgcttaaaatcatgtttgtgcatacaaattaaaagtatccagaagaagcaataataagagtacacttctcatttaacaccaaagtctcttctgccttgctcgattaattgtcactgaatgcaattttatcatagttaaaatgaattcaggtctatttccaggtagtaataattttgggggggttatagaaattaatgttcctcaaaaactaattaataatttctaaagaatcatttgcataaaggatgttcgagtcttgtggccatcatgtgttgtatgtaactaattcacaggtccattttcattactgcatgtagctatgaggtgacaggcgtgaccactccaaatggccaagcaaaaggccaactgattgagcaatcatttagcagcagttcatccaatgatcacattgtgtttttcagtaaggtctgtcaacaaaataaagaaaagaagggcaggaggaagggaagtccaccaaaatagtggtgatgttgtttgaacttaggcttttctctaccataaacttattgttcttgagcctggttcatttctgcattttaacagtgtactatgcattaagatgaagtcttgatctcaccataaacctgtatggaaacaggttcattatataacacatatttttatattagcagaaataactttccaacttttcatttgttttgatgtcaatgtattataagaaactcttgcctagaagtagagctattgtgttgctctgctgaaaattactgtgtataacagttttaatatattaaatttgtttgacttattggtagagcccaccaaataaggaccatgcaagagagcataattcttagcagacagaagatccattcactatttctactataattacagtgaaaacattattgataaatcaaaccaaaataattattctttgaaaaggaaaggatatttgtagctttctaatgccacgaaagatgctgagtgtaaaatgttcacttgctcactctcaaatgtgctgggacaatccagaaatatcaaatgcaactttccacatcatttcctccaccaaacttcatttccaccatcaacagtggtgaaattataggccttcaaacacaacatatggaacaaaaatcattttatcagaatgaggatgtaacatcaactccccaccccaagctcaagcaaaagaaaacaaaataaggagtttttatagctttgaagacaatccacaggaggtaaatttccccccatagcaagaccctactggaaagtgtgtgctaagaaagcatttcaattaccagctagctgaacatgattcacaattttcaaataaacttttttccagttctctgaatatgtggaaaattacatgaagaaatagatatagaaaataagaatgctaaagtcagcagttgaaaatagagaaagtaatgttgaatagcttgctcaaataaacttattgaaacctcactaatacattatcttggtggactccatttttgaagataatacaaccgactgatgtcattgtgagctgcaggcctccaggtacctggaaggacctggatggaatcaggagtcttttttactgtacatgtgaagaatcttctggcttggggaaatggttgttttggcttattctctgcccttgaaaatgcccaaggcttttgtgaaatgtgaatgacctcatttctgattgctgtgtgccaggtcggtctgtctgctgttgttatttccccaaagtggacagttaactccatgttgtttcaaattgtgtttttgtattcttaaagcttttcttcagactgctgtgcttatagccattgtagggcattctcacagcaaaacacttccacaatcttactaaatataataggaaaaatataaaaatcacttcgtttgctacatgacacaaagtgtgagcatttgcttaaaaatgtccctaaagaatgttgctgaatatttgcatcaagaaaaatctctttaattgcaaaatagcaaaacaatggtttaaacattaaaataacaccctaggttagcagcagtcagaataatcccccaaagagacttaacattctcactaagatagacaaaaatgctgctatgacaaaatgatcatgtctacattataaaagaaaacagagacaattcttagtttacaggcttgaattctggaaatatatataatccagtttataagaagcaatataaaccagtatacagagttttagttcggcacttatagagggctgaggtgtaatttagtgggttttcttattcttcataaaaataaactgcgcattttatatatgtaggagctttttgaagtcatcagaaatcatttggcttctcatttttaaaaaggttttagattcgattatctccaagatattttatcatgttttattacaatgactttaatttcattgcagaataagtgggaaattaattaatatgtgcaaataatataatattttaagtaatgaagtatatccatagtttgatgctttttttgataactgtgtttaaaattttatatgcccagcatcattaagaagagttcaggaagggttttaaaatgtattatgttttgtgtagtcacataataaaattcaaattatgttgcttcccccccattcccactcagttactaaaatcatttatatatatttttaatttttaaaaatttgtatgccttggatacagagagagtatttggtgtgatcttttagggaatgccagagaagcaacattaatttagaaaagacataaaacaatatggtgggaaaagtagaatcaggaaattcttgactttttgttttggatgcaaacacatttcacaacagaaactatatattaagataggtgcactgtgcataatatagaattttcttttgtaatgtaagatattgctttatacatatagttcataagacttgtttcatggtgtattatattatatatggtaacttcagaggatccgtacttgtggaactttgacatgaggaaggtgcatgaagagcttaaatacacctgtttgtattttctcattgtctttccaaatgccccaattttatgatgtaattttagagaacttaaaggtaaatggtgcaaaattagaaaaataaattgtattgagctatacttaaaataactatgatatttacttatttttaacgcatctaaactaataggaattagtcatacaagagtgtggcaaatagcttccgcttgtctattagcttataggtactaaacaattatcctcagggaacttcactataacatgaggcagacttcatttggcaaatatatgtagtatttgatctttgattttgcctaccctcatctgcaatatgtgctaacacagagttaggaaatggatgaagaaacagtttattaagtgaaaaatcagttctggcttctagatgtattgatttgtattcctggtaatgaggccagggaaagcaatgctggaacaatatgttccgtagatgttggtgacaaagattattttcatgaccaaactcttgatcgttctcctatgtccatctgtgaaccctgctaaatcagtttagcaagaaaacctcaccctcgatatctgatcatcctcaatatctaagcgggatcctcatcctctgccatcccccaggtaaggtctgatcaccctggcctgtcttcagcaagaattctgttaggtctgtttagacagaatcctccttacttcttagtcatttcctatccactggcccccatcctgctccttggctataaatttccgctttcccatgctgtattgggcattaaacccaatctctctcccttactgcaaaatctcgctacggttgtccttaatatctatcatgatggccttgaagaaagacttccttatcatgctttaacaactatcattgaataactttttctgtttgtttgttttaattttattattattatactttaagttttagggtacatgtacacaatgtgcaggtttgttacatatgtatacatgtgccatgttggtgagctgcacccattaactcgtcatttagcattaggtatatctcctaatgctgtccctcccccctccccccaccccacaacagtccccgaagtgtgatgttgcccttcctgtgtccatgtgttctcattgttcaattcccatctatgagtgagaacatgcagtgtttggtttttttgtccttgcaatagtttgctgagaatgatggtttccagtttcatccatgtccctacaaaggacatgaactcttcattttttatgactgcatagtattccatggtgtatatgtgccacattgtcttaatccagtctatcattgttggacatttgggttgcttccaagtctttgctattgtgaatagtgctgcaataaacagacgtgtgcatgtgtctttatagcagcatgttttataatcctttgggtatatacccagtaatgggatggctggatcaaatggtatttctagttctagatccctgaggaatcgccacactgacttccacaatggttgttaaacactgagtagggaagccagtctcagaaaaaggacaatgtactcatacactgttgggaagtcattctcatcaacggtcaaatcatttgctgatgtgagccacaagttaccttttctgttgtacataggaagagactactattagttagatattgactatttcccaaggtctagaagattgaataataacttacaaaattgttctaatatagtttttaaactagtactgttctctaaccacaatcttaaattgctcagtaatttccaattttcacttacatgacagcagtgtggatgaagcttttataattactgagctactacaaataatcatgttttttgtcacagaaataagatgattgaaattcagcattcagctactagttggaaaataccacttggcttttataatttaaaatattcataagtacaatgtataattttattttagatattaatcataaactgattcatgaggacacttataaaccttgaatgggcagtatttatggcattgtagttatgagcccaatcactgtatattagagatgtgagctcaagtccattatttgaattctctatgtcttagttacttcatataaaaagtgagaataatggtgtctgttttctagagttgttgtgaatattaattgtaaatctcttaaaatggtacctgacattctataagcagcatataattacaagctaatatcacagagaagctatatatttaatcaaatgtgtagcattatttccaaatattggagaaatggtaattttcattatgaatgattttatatactctccatcaagttactgaattactagaacaaagttatgactcttcctttagataattattttttcccctcctctggctatagtttacttaaattacttagaactccttttagtaacaggctgacttctaacgttggtaagaaactatcataacatgttattcagaaaatatcaaaactagatatttgtttttaatggaacttgttcaatgtgtcaattatctggaatattgttatctaatatatgtgttatgggtgaacacaaataagattgcctcttccaggtttatcaatttatatttgggatatggagactggaagatgcaaattaggataatacaccaagcagatggtaagtaaagaaaccagtctacagagaaagaacaaggaaacagacagacagaaaaatagatacatacatagcaccgttatgagagggagaaaactgtccaagtgttatttttcttcctttaaagccctattgtattgtacataatataatcatatgtatgtatacatatatacacatatcttaattcatatatgtagtaggctgagagcccatttctgatgatgacgaacatattggctctcttgaacagcaacttcttattggtcaagcagacaacagtggagagaagctgacactcttcatttcttagggaagaaacaatacatgccaagacataatggtataagagcaaattgtgtttgcgggagtaaattcgtttctaagtataagatgccagggtatgtctggtgcagtggtcagagatgatgctgaaatggagggcagaagccggatcatgaatgaccatgctttccccactgaggagtttgaattatattctgtaggtgatttgcgtcgctaaaggatttgtactggggggatgacataatcagatatttgttctagaggttgacatttgaaatattcatatatgatagtccagatatcatgttcaagcaaaactcatgattctcttctgttccattacacacagaagtgatgaaaatacaccttgacaatgaaacttaaaaatagtcatcaaggccgggcgcggtggctcacgcccgtaatcccagcactctgggaggccgaggtgggtggatcacaaggtcaggagaccatcctggctaacacggtgaaacaccgtctctactaaaaatgcaaaaagaaattagccaggcttggtggtgggcgcctgtagtcccagctactcaggaggctgaggcaggagaatggcgtgaacctgggaggtggagcttgcagtgagtcaagatggcaccactgcactctagcctgggcgacagagcgagactccgtctcaaaaaaaaataaaaaaataaaaactaaaaaatagtcatcaacccatgcaagaattaactgaaaaatgggtggggctggaataacatgacccttggctatgcctaccttgagggaaataagatagacaccagatttttacttatctactgtctagctggggttaaagtgaatgcataaactaaaaaacatgcaggcactcacaaaatctcttgtgaaatgggaaatgaacagagtaacatattaatcatattaatatactacctcctatgtatggtgttttttttttttccctgatagagaattgtgattaaaagagtttggggaccactgattttattttgcacttattcctgttttaaagtcttagaattagacaaaggtcaatagtacaatatagtcactgtagaatgatcctgaggtaattattggatacaggattaaagatagtagtgcaacaatttacttctggctttagatttgagaaaaaacttttccagttattacatggagttgagaattaggagtgggcaattagaaaaaaattaacattattttgctggcaaaagtcagatctaaaaaaaaaatcctaattcaaaaatcagtaaagagataccaaacaaatgttaaatatgaataaagataactgtaataaagtaaaaataaaatctcaagggaaaaagggattgctgttttctaggcaaaatttaagaagagacccttacctagagatagattagtggtgtcttcaatctcaagaaaaagaaaaaaatcctattggctctcaagcagaaaagtaacaataagaaaactctggttactttaaaaaatttataataatagtcttctataacataaaattccagaagacaatggaacaataaccaatgataacatattgagagaaaacagtttttaatcaaaatgttgacagtgaagcaagttgatgtttattgtaaatgcaacaacagaaaaaataactttctcagaaatctaatggcttccaggatgctggggtagcggcagtagagtgactgattccaagacttactcctactgagaaactggcttagagataaatacaactgaataattcaaaaacacgtacttcagtttgaaagaactactcatgagcactgaaatagtaacatgaaatgacaaatccaatcctcttctgttctcatttgactgcataaaacaaaaggggaatatttatgattccttaaaatacaataatgattgtttagtttgatatttcaagattgaattcatgaaaaatagaagtgggtgagatgaagaaaaataaaagatatttttccctccagcaagaaggaaaagaaggtcaatattttggtgtgtttgtttaactttcgtattaggagaagtaaattcatgtaggttttgaaaaaacttacagacaaataacactggaattttttaaagtttgactttcaagtcattgcagataatggatgtaataatagcttagtacacataattatagactgaaaataaatgaaacaattaggaagcctgataaaaaacataaaacaagaaaacagaaatataaccaaggtcatcagttattgctctaaatgttaattgataaagtcccctattgtaacaaaatgctctgagattgtattataaacaaaaactaaaggaaattcaattatatattgcccataatggaaaaacttaaagcatagttacacttaaagtgttgaaagaatgggcaaaagcttattagacaaagaaaaggaaagatacacctcaattttattagtgatggacaaaatagaatttgaaagaataaaaagtaatatattgatattatatttatattgagaaaaggtacattccacagtaaggctgtaatattaatgagtctcattaaaatgtgaaccttgggaatagagattatcatcagggccaaacacagtgacaagcgcatggaacagatgcttattaaataaaatggaccaaggatagtaattttttgttgctaaaagttaataataatcactcactctttggctctgtatggaagggatcatgaagctcttttatgggccttagttccttcagatacaattcataatgaagacaatcccatcataaaactgtgacaaataatagagcagcaaaatgtttatgacaaaaaccatcaaaaatctaaaataaatagataacacacaattactggaagagctattagtacatcactaattaaaatactatgaaatatataaaatatgacaaataaaggatttgagcaatgaaattaataaagcataattaatatataccatattttgtgcactacaaatagaatacacttttaaaaatgtgtataaatttaaagggtacaagtagagttttgttgcatggatatattgcaccatggggaaatctaagctttcagtgtaaccattacctgaataatgtgtgttgtgcctattaagtaatttctcatcctttacccacccccctttccccctcctacctttctcagtctccaatgtctattattccacactctatgtccatgtgtgtacattagttatctcccatttataagtaagaatatgtggtatttgaatttctatttctgagttgtttcacttaagataacagcctccagctccattcatgtggctgcaatatacattatttcattcttttttatagctgcatagtaattcatgatgtatatattccacattgtcttcatccaatcatcctttcatgaacacttagattgattccacatctttgttactgtgactagttctgcaataaacatctgagtacaggtaatctttttgatataataaactattttcctttgggtagatatccagtagtaagatagttgtactgaatggtagttctatttttagttctttgacaaatctccatattgttttccatagaggttgtactaatttacatttccaccaatagtatataagtgcacccttttctatacatccttgccaacatctgttatgttgagactttttaataatggccatgtggagattgacgtaagattatatttcactgtgggtttgcgtgtctctgatgattagtgataagtattttttcataagcttgttggcaatttgtatgtattcttttgaaaaatgtcttcatatcttttgctcactttttaatagtgttacgtttttgttgttgttgaattgcttgagttccttgtaaattctgaatataagtcccctgacagatgcatagtttgcaaatattttcttccattctgcaagttgttagagtatgtattttaaataaatttgaataaaagaatgagtagatgaatatattgtgtgtagagtgggttccattattgagatagtaagtgtgaggttatgatcagttttagaacacctgttgagacctactgctcaaaaaaattcctttcaaaatattactgttcattgagaatgcacttggtcgctcaaaagctctgatagagatgtatgaggggattaatgttgttttcatgcctgctaacacagcatccattctgtagcccatgaatcaaggagtaactttgactttcaagtctttttacttaagaagtgcattctataagtctgtagctttcacagtgattcctctgataaatctgcaaaaagttagttgaaaaaccttctggaaaggattgactgttctagatgtcattaaaaacactcatgattcatgagaggaggccaaaatatgaacattaataagagtttgtaagaagttgattccaatcctcagggatgactttgagtgtttcaagacttcagtggaattagtcacagcagatgtggtggaaaaatagcaagagaattagaggtagaaatggagcctgaagatgtgactgaattgctgaaatctcaaaataatacttacataaatgaggagctgctttttatggatgagcaaagaaagtggtttcttgagatgaaattcacccctggtgaagatgcagtgggcttttttttttttaatgacaacaaagaatttagaatatttcataaagttgataaagccatgactgggattgaaaagactgactccaatttggaaagaacttctactgtgggtaaaatgctatcaaacggcatcacatgctactgaaaaatctttcattaaataaagggtcaactgatgcagcaaagtttatttttgtcttattttaagaaattgccacagtcaccccaatcttcagtaatcaccactctgatcagtcagtagctaccaacattgaggcaagacctcccaccagcaaaaacattacgacttgctgaaggctcagatgatcattagcattttttaccaataaaccatcttaaaattaaggcacgtacattgttttttagacataatgctatggcataattaacagaccacagtattctataaatttaactcctatatattaactgagtaccccatttttttctaagagaaatgtgtttttcattatattcttcttcttttctcttttctccttttcccctgttccctacttcctatttcgctctttagaaatacagttataacctttaccttctcttcacaagacacttactacaggacaagcttatctaactatgtacttacttagaagctccagagcaagagctctttcccaccaggagattgcctcaagagacaacagtcaatttacaactgatgtggtttggctgtgtccccacacaaagctcaccttgaattgtaataatccccatgtgtcaagggcaggaccaggtggaggtaactgaatcttgggggcagtttcccccatactgttcttgtagtgaataagtctcatgagatccgatggttttataaatgggagttcccctgcacacactctcttgcctgccaccatgtaagatgtgcctttgttcttccttcaccttccattatgatggtgaggcctccccagccatgtggaactgtgagtccattaaacctctttccttcataaattacccagtcttgggtacgtctttattagcagcacgaggatggactaatacaaaaacctaacatatgcccaccagagaaaactctgtcccacctggaaaatatctcatacaatgtccactttatagcctagttcttcccctaatggtgccaactcgaccacccaggagagaaggcactgaagtgagtcacatagatccccacctgctcactgcctcccctgcatgctgttcaccaactcctgcttttaaagcccctgcgttctgtcccaaaggagaagtagcaccctcaaaggcaggagcctgtccctcttcctttaagctaaactttgagataaaaagtcgcttttggtcagatgcctgtaatcccagcactttgggaggtctaggtaggtggatcactggaggtcagaagctcaagaccagcttggccagcatggtgaagccctgtccctcctaaaaaatacaaaaattagccgggcatggtggggtatgcctgtagtcccagctacttgggaggctgaagcatgagaattacttgaacctgggaggcaaaggttacagtgagctgagtttacgccactggactccagcctgggcgacagagtgagactctgtcaaaaaaaaaaaaaaaaaaaccaaaccataaaaccagtcactttctttatatcagacctcactcttgctaattggactgcaagcagccagtcactgaacctgagatttagttacatatatacactgggaaaccaaaattttgtgtgactcactttattatgatatttgctttattgtggcaatccagaacagaaactgcaatattgctaatatatgcttatatcttattctgttcataattccgttatagtgtatctaaagtatatcttttcccactttacctcaagaattaagtgaattcatttttgtttctatttctaagtgtccatctgaaattagcacaacttggagttcatttcattcagggacaaaaacaaaacagtttgtagggagaaaggcaaagggcttgtctcctgactaccatccttgttactggagattgcagagaattatcaccataactggagctggaaaaatggtctcatccattgggaaatgtctagaagaatctgtttgacatcaaattttttcaatattttatcccagaatttgtgccttctccttttagttccaactctttcccccttcctccagagtattcatttgtcaaatcccaatgctttttataactgaagttataaaggactctggttagacaatattattataagatactggaaaaatagtgtaatacctgaggtattttctgtccttagtgtgttttttgtgtgttggttggggaaggataggtatataacactaaagtctgagtattctggccttacaatgtaatcataatcgagtcattctcaataggtatcttctttttttattccagataactacttccactcacaatgagatgaattgtctttttacagaatttagggattccaagttgcctggttttaatataatacatattcacaaaatttacacagctcatgcataccataacttatacagagaacagtttagcagtctgcttaaaatgttaaaaaaaaatcataaaaagccattgttctgttacacataatctgtactgaagtcataagcatcatcctcttcaatgattttatccaagataaaagaccttgtagactcagtggccctgtctcagaacaattaaataagagtttctgggagccagtcacagtcattgctatattttagccccttcttagatgattttccgtataattagttttaagaactacaccttacattacagactttagaaatttcatattcttattctttgtttccaggtcaactgtaaattgagtagttttgtgagtacttctttcagatgcctataatttgaaaataattctataaactatgacgctggggttttgctaaaaataagcatttgcatatcacttttatgatctaacatggtatatccaagcctgttcagagtttaacattaatttctaatggttctcttttatagaatttaacttgtgaatttattaaaatatactaaacttgctcaccctcagggtatgtgagaatgagcttctgcattcctgggagcaaattgcagatcagcatttttagtgctgcctaagaccctttgtgtgtgtgttttttaaaattaccaacatagatcaagtttatgttaattgtatgaaaaagcaacagaaataatcagtaacatttacacaactttaagtagttaacctagttctgaggcagcagaattattaaatagtcagcaccttaaagtaggcaaaacatgtaatgaagcatttctttctactagcgtgtttttctttctgcaggcatggttgagtattgaggtgtacatgttggggttgtagtgatgtggtttaaatcaaatttatctcaacttaaactaaatatgtttctttacatatgttaagcagtcttctgtgagtgacttctttcttcagaggttctgtgcagctcttaaaaggagtagaaagatcactaaagtgacagcatagaacaggcacaaaaattgccttgtatacaattgcacacacacacaaaaagaacaaaatagctgtattttaaaaactttataagaaatcaacatttattaagagtatacttctatactttattgactgaacaatagctcatctttttcttgagaagaaagctcctgaatattgtggaaaataaaacaaatcttagaaacaagttactatatactgcctcaggggctgagtagcattttctgtctaaatgacacattactgtgcattatcacattgttcttccaaataaatctgtggtttcgtcaatgaaaggtgagtaataggttcattttttttcttaagattttagaaggaacatagatctaactaaatactaccagcattattaatgaagatctatgattaattaaaagcctatggagctttaaaattaccactggctactcgagaattagagcggcccctcctgttcttactctactctttctccctctcacccacctcctgatgaccttgtcactacactggacctttcatcattgatctgctattaccagactcttactctagcacgttttgtttttttctgtcccatcaccattccagaggtttttctcttaaacacagatatacatgtccttagaacattatagaccccagtgaaagcttattttacaattgtggtaaaaagcagataacatataatttacagtcttaagcatttttaggtgcatagttcagctgtgttaaatacattcacgttgctgtgaaatagatctctggaactttttcactttgtgaaacaactcccccttttcccctggtcacaaccaatttcctttctgtttttaagcatttaactacattagatagctcacgtgaatcacacggtatttgtctttttgtgactggtttatttcacttagtaagaactttgttttttgtcctgcgtgatgggaagctattagatgattgatatggtttggctgtgtccccatccaaatctcattttgaattgtagttcccacaatcctcacatgtcgtgggagggacctagtggtgggaggtaattgaatcatgggagttggtttttcctgttctgttctcgtgatagtgaataagtctcataagatcctgatggttttataaagggcagttcccctgaacacactcttgcctgctgccatgtaagacgtgactttgctcctcattcaccttctgccatgattgtgaggacttcccagccatgtggaattgtgagtccatggaatctttttttctttataaattatccagtcgctcggtatgtctttattagcagcgtgagaacagactaatccaatgatcttgagcaggggagtgacagaatctgatttacgtttttaaaaggtcaccctgatattgtgaagtgtgggtgattttgtgaagagatgatggcagcttggatctgagtggtagtggcgagtcaatgagaagtgactgtatttcagttatattttcaatgtagattaaagctattaaggttttgccattactttcaatagcaaaaactgcaattacttttgcaccaacctaataaaagtcactgatgagttggatagggaggttggattcataagcctgtgttctgtgtagctgggagagtggtggtgctgcttcctaggatgcatatgctccttagaaagggagtggaagagactgaggtgttttcctttgcacattaaagagtaaaaattgctgagaccagctcggtcatggaaaccgaggaattaaagacatacacacagaaatatagagtgtggagtgggaaatcaggggtctcacagccttcagagctgagagccctgaacagagatttacccacatatttattgacagcaagccagtgataagcattgtttctatagattatagagtaactgaaagtattccttacgggaaacaaagggatgggccgaaataaagggttgggtctggctagttatctgcagcaggaacatgtccttaaggcacagatcgctcatgctattgtttgtggttcaggaactcctttaagcggttttccaccctgggtgggccaggtattccttgccatcattccagtaaacccacaaccttccagcgtgggtgtcatggccatcacaaacatgtcacagtgctacagagattttgtttatggctagtttatggccagacatgggggccaattcccaacaagaaaaattgttcaggtagttggatttaggagacttcacagggtagaaattggggtcagagatgtaaatttgggaatcatcaaaatatagaaaacatttaaaacctggatcctggagagagtctagttagagaataaaagtagtctgagggccgacccccggcccccggcatttggaggtctaatctgcactgaacgctccgtttgccagcatgctgctccaaagtcgtgctttatcccttcccagggaccctgagaggaaattttaagcataactccacttacaaaatatcaagaaattattcaaaattaattatattatctggtacatgatttcctactcacattcttaagtgatattcagaacacccttctgaatggtgatatactctctgtaagataacttttttttttgaaataaacatctgtgtatttactgattcaaggagcaattcctctccttgcttagactgatgtgtgcttatttgcaatgttgagattttatagtgtaaggataaattcaaattaaaaataagagacttaattctttctgttgaaaataaggaaaaagacttcttcccactctcttttctcagataatttaatttagaccacttgtttattctttctctgtctttaaaaatatatttcaatcttaaaaagctaaagaatctctggaagcttcaggacccaggaatgttttgcttgaggatctgagaaccatctcttgaaaatgtaatcatcctcaaggaaaaaagtgtaactggacctaagtccagcagtccactacccaaaagccagtcttgagagacaaggtttggtggaaggaaaaatcggattgaatcaagtgccagagggcttgtgaagatgctgaactcaagtcataaagaccatctcaaattttaaagtttatcataaggttttaaaagggaaacttgatatgggagacatgcaggactggtgcagagtgtaaggtccgagtgtctttttctgctggctatcttgggtactcgcccatctgaagatctggttggcattatcttgactttagcccaatgatggtggattgatagttcacaattcctcctaaagagaattctaccattagggctccatgccttgtttcaaaagattagtcttttgagtttcttaaggaagaaaataattaagtgagtgtgcattgctggggcgggggggtaggggagtgtctagagaggtaaggaatgaaggggtgagggaaggaaaggaagaaaaagagagtaagtgatttaaaaatgcatttttaaaactgaggtccccaattacaaaagtacaccgacctcccaatttctgtgggagggtaggaacctgacattggtaggcatctcactccaagttgcaaaactactgcttttcataaagatatgagaagtttgtttttcctttggataaagccaaaggaaacacagatggccagcccaatgaccaagaatccaggatgaactatgtgttgtcacatatgtcacagtggtgctgtgaagtcctttgatttgaggactagttattgtttatcttgggaacatatatgtaatgggttgtatctgcttggctatataaaatgagatttctttctgtttttgcaatctcttagcaattattgtgatgcacatcatgtcctggtttaatgctattcaataatgaaattattttttcttttctatcttattggagcaattttctgggttggcagaagagttcgtttttaagtatatttctttaacaatagttttaaaagtgtgaagttggaaccaaatattgttttaacagatgaaacggaggtccagggaatgttactgacctatcaaggctgacaaagctgatcagagccatgtttagaagcagtagcttctactttcaacatagtgcgctttctgtactccatgactcttgtccacattcaaaagcttaattgtttttgagtgttcccaatatgcatagctaataaatccggggtaatagttttttccatgcttcactggaagcgaatcagcatgatttgacttctaaggttattgacattttctaagtgatggctgctcactgtaatgtgtacgaacctatttaacagaattaatgaaaatctaatcatttctgcattttgaagatgctgagttaagagaaagagagaaaaacaaagaggggagcaaaagcactgcaaagatgaattgatttatgaatatcaccctagctattccaataggatatgacatgaaacataattataagatgaaaacatacatgtgtattaatcttaatgagagaaattcagagaactgatgcataactacaggattgagagctaacaaaaatagagagtaataaatgttttactccagtagttttgactactcaggggaaatagatttggaataaaaatgagatgtgcaaaccaatctaacttgtaccaatatatactgtaaattaaaaaaaattaaacagccaatttctaaactagcatagatgagaataaagaaatgtgaaggtctgttgaatcaatctttcaaaagactgtgatgcataaaaaattgtgcttaaaaatttacttccatgaaacagattcttaaaaaatatcaaaggaaagcttctaacctgcaatcagggtacttaaatttagattagaagaggcagttgatgctctttcaatccattttgctattattatgcacgctaaagcattagaaggaaaagagttaatagctgaggagaaggggggcaggtttgaactgaatgattaccctcattttaatgtgtgaacttgaccaaagagtaaaatatttggatttttgaggaaaaagggcatgcaggaacaggagagataataacctcacaaatgatttcaccaaagtgttctatataatttactattgcaatatttgtttttcaaaagtagtatcatgtatcaaaagaatgatgcttatttcttatcagtctgatctttgttagataaagcaaaaacagtgatgtgcagaaactcttcagttttaatttgcatttgaatgtaagcaaattgattagtattacattcacctattttgctacttataaagtggttttgtcttgtgtagatctgtatgtctgtaatttaaatgttattttaaactcctaagtttcatttgtaattcaaatttgcattaatttactgaacgtattgttatgggtgggtctttgttcttagagctcccaagatggtggtagtccgctcccaagatggtggtgggctgctcccaagttggtggcaagccttttgttctctgacctgaggttcttggcctcacagattccaaggaatggaaccttgggccatgcggtgactgttatagctctattagaaactaagggtcacagaggagaactgtggaacccagcgactagtgttcagctcgaataggacgaacccgggtgcttagccatgcaggaacaatggcaagcctctagcccaaatgggaggggcaatgggtgcctcactggatcagaaacacagcagacaccctgctgggtctggaggggtggaagtcaatggcgggtctgtgatggctgcaaacagcagtggtggacagtgagggaaggctcagctccagcaggaacacagaccagagaagcatgcagttacaagatttaaaagagtgaaaacagagctcccacacaaggggaggggacccaaaggggttgcccacttccggctcgaatgcctggggtttatatcccaatcattgtccctcccccgtgctctcagatgatagatgatttgactatttctttacctcctgcttttagcctaattggtattttagtgagccctctttactacctgattggtcaggtgtgagctgagttacaagtcccgtgtttaaaggagggtgcggtcaccttccctagctaggcttaggaattcttagtcggctagtcctgtctctcagtatcccaataaattggtgacatatagaggtgtgaagtttaaaagagtaaatcatattttgtttagacttgttattttgaacatttattacttaacagagttggaggaagaaatgaactatgaaaatactttaaatatttgaatgtactaatgcctttaaaattattttataaatcacagaacatccattttgataatagatactctaacacaaaataccaattttattgtaatattggtagtggcaaaatacttgctttgccatttaaataaaatttaaagtaagcctgcatcccagagtcacattttaataattgtaaactagcagaaaataagaaaacatgattgaagcaattgcataagacatattgagagaatgcacattcagctatggtgtacatgcttattacaggaatagaggccgattttagaaaatggagaacaaattaagtaaaaaaacaaaaaaacaaaaaaaactttatactcaccaagtatagccatcatagcatatttgcattatatatatttcctgtcactattttttctatgcccaaattgtgattaaactctaagtacaattaaaatggttattttcaggccagccgtggtggctcatgcctgtaatcccagcactttgggaggccaaggcagctggattgcttcatctcaggagttaaagagaccagcctaggcaacatggcaaaaccctgtctctgctaaaaatgcaaaaatcagctgggcatggtggcaagtgcctgtaatcccagctacttgggaggctgaggaaggagaatcacttgaatccggaggcagaggttgcagtgagaggagatcgtgccactgcacagagggaacgacagagggagacagagccggggcgacagagggagactctgtctcaaaaagagaaaagagtgattttctagcttgatattatattgtaaaaattgtctcatgtcattaaaatccttcaaacatctgtttatactgcctaaaatagtcttttgtatagatgtgccataattattttttgattattgaaattttgacttatttacattatcttctatacacaagattatgatgaagattttttaacatatttttatgtttaaatgtgtgatgatatacttaggaataagaataattaagttaaattatatagggatttgtaagtattttgatacaaactgttgaatgctttccagatgttcaaacgaatttatattctgtaccaacttttcaacacaaaatcatatttaaaagttattttccatatgttaaagcatcagtttcttcatttgctgcaacaactacagaaatacagtattaaatatattcattaaacaatttttttgtttaattgcttattcattattagatttccctatttttcacatttattttaagagagtgtatgtgtgtgtgtgcttatgtgtctgtatatgagagagagaatacaatattaaacttggcattgaaaaataaccttccaattaaaaaaaaatgttaatttatgttctttttgacattaagaaggtttagttatttttcattcagatctatcaacattttctttaataattgctttcgttttttaaataattaacaaattgcttccaatttagcaataaatatttctttattttttaaataatttatttaaatattcacttttttgtctatttgaaactgattttggtttatggcattaacactactgattactatgttccttctccattggttcatgatagttctttcagcatgaaatcaatgtttataaccattagagtctattttatggaagtttactatattccatgaatttgcctgttaaatatgatattgtaagaggttgttattatactgattgattatactgtgttgttttatatagcccaattttaattattttatagcttataatttattttaatatccagaaagtcatgtcacttctcattactctttcttttccaaaaatcttagctattattgcctctttatttttccagatgaagtttatagttttttaaaaaagatgagaaataaataatttgttattgtgttggaaatataaactatttaaaaaagaaccacagtagttgatctcctcatccagactcatggtaaatctctccatttatcaaagacttacttagacttacttattatctctgaggaaaagtttcagggttttatttatatatgcacatagcttgaagattatacctagacattttatgtttttctctttctgttttttttctgaacttagatgaatttatgtatttgcgtataagaaatgacaaaatgttatttaaaaatgattagcaactttcaaaaatggcatttttcatattggcaagctccaggtgaaactggtatagtcatgtgttacgtgggtgctgaggtgggtcgtagtaactgctaacacttatttagtgcttacactttgctagacttcatcttagcagtttcttttttttttgagatggaacctcgctctgttgcctaggctggagtgcagtggctcactgcaacatccacctcccaggttcaagcaattctctgcttcagcctcccgagtagctgggattacagtcgcccgccaccatgccaggctaatttttttgtatttttagtagagatgaggtttcaccatcttggccaagctggtcttgaactcctgaccttgtgatcaacccgccttagggtcccaaagtgctgggatcataggcgtgagccaccgagcccggctaatcttagcattttctaagtgtagtgtcatttagactaagcaatagcaatataaggcaggcactgctatcacagaaagttcaaattcaagtaaaataacccaagtttaattaagtggtactgctgccagaactcaaaactaggcagtctaactccacagtctgtgccagtaatcattaactttttgtttttttattataatagttttattgaaatagagtttatacaccacaaaatttacttacctcaagtgtacaattcaattgtttagtatattcacagagatgtgcaattgttaatcaatggtaggacattttatcacccaccaaaaatgacctgtacctattagcagtcattctgcattttctctttagccatttccagcccctggcaaccactaaactactttctgtgtctatggatttgcctattctggatgtttcacaaatagaataataaaatatatgactttttgtgactggctaatttcacttagtatgatgttctacaggttcacccatattgtaacatgtattagtactgaatactcttttatagacaaataatattcctttgtatgattaaatcacattgtttatctgttcatcagttgatggacatttggggtttttctatttttgactgttacaaataatgctgctataaacattattattattactattattattatttcagatggagtctcactgtcacgcagattggagtgcagtggcacgatcctggctcactgcaacctctgcctcttgggttcaagcaactctcctgccccagcctcctcagtagctaggactacaggcctgtgccacaatgcccagctaatttctgtatttttagtagacatggggtttcaccgtattggccaggctggtcttgaactcctgacttcaggtaatccgtctgcctcggcctcccaaagtgttgggattacaggagtgagccattgcgcctggcctataaacattcttgttcaaattttttgtggctgtatgtttttcctttggtatataccttggagtgaaattgctgaatcatatggaaactctatgtttaacattatgagagattgctgaacggttttccaaagcactgcactatgacacatttccatcagcagtttctgagggtactgtcatattctgtttgtgctgctataacagaatacctgagactgttctaatttatgaagaacagaaatgtgttttctcacagttctggaggctgggaagttcacgatcaaggtgccgacggggttagtgtctggcgagggtagctcccagcttccaagatggcaccttgttgctgcatactattagggggagggacgttgtgtcctcacatggcagaaggcagaagagcaagtaagcaagcaggactgtgcaaagcctccttcgtaacagccttatttccattcatgagggagctctcctggcctaatcacctctctgaggctctacctcttaatactatcacactggcccttagttgcaacacctgaattttggagaggacaccttcaaaccatagaaggttctaatttcttcacatcctccccaccaaaaactgttattaggtggctttttgattatatatattttcttggaagagtaagttggtacctcctagtgggtttgatttgcatttccctaatgactaaagatgtagagcttacattttgcttactcaccattgtcttatttctgtttgggctgctatgacaaagtaccttaaactgagtaacttataagcaaaagaaatgtattcatttcttacagtgatgaagacggggaagtccaagattagggtgctggcattacctggtgaaagctcttgttctcacagacagagtgccttgtagctgtgcttttacacagtggaaagggtagacaagcttcttcaatccatttttatttttattttttgagatggctttcattcttgtcacccaggctggagtgcagtggcgtgatctccgctcacttcaaccttcgcctcctgggttcaattgattctcctgccttagcctcctgagtaactggcattataggtgcctgccaccacacctggctaatttttgtctttttactagagacggggtttcaccatgttggccagtgttgtcttgaactcctgacctcaggtaatctgcccacctcagcctccaaaagtgctgggatgacaggtgtgagccaccatgcccagccttcaaccatttttatagtcactaatcccattcatgagggctctgtcctcatgacctaaccacctcccaaaagtccccacttcctaatactatcactttgtggcttagggtttcaacatgtgtaattggagggcgacagaaacatttaaaccataacagctgtctgcatatctttgattcaaattcttttcctattctttttttaactgtgttgtcctttgttgagttgtctttaggatattttctgccattttgtgtaatttttctttttacttttttgacatcatttattgaaggagaaaagtttttaatttttatgaaatcctaatttttcttttgttgcttgtactttgatgtcatatcaaaaaagcctttgtctaaccccaggtcacaacaatttactcctctattttccagttttagtatatgtgctgccgaggcaagcattactcctctatttcttctaagtgttacatttaagactctgatcctttgtatttttatttttatttttttgagacagagtcttgctgtgtcgcccaggctggagtgcggtggcgggatctcggctcactgtaacctccgactctctgggtcaagtgattctcctgcctcagcctcctgaatagctgggattacaggcatacaccaccatgcccagctaatttttgtatttttagtagagacgggatttcaccaccttggccaggatggtctccatctcctgaccttgtgatccgcctacctcggcctcccaaagtgctgggattacaggcgtgaccactgcgcccagctcaactctgatccattttgagttaatttttgtgtagcgtgtgaggaaggagtccaacttccttctaatgcatctggatgtctggttatcacagccctattttcaaaccaggatttgatgttgtcaataactagtccagtgtcctttatcatacatacatgaatgcatacacatacacttacatcctttaatagctcctgatttctcttagtgtaaaggtgtaaatctttaccatgatttacaaagatcatcctcatgcctgtcaaattacatgactgcaagggaccattcacctcccgggcttcatttggttttttagctcttgccgccattgtcatcaattagatgcctaagaaatgtgttttctttcactactggatctttgcacatgttatgccattctcatgaaattttctttcctttttttctattttaatcactcacactcatccctcagagttcccctcagttgtaatttccttaggtaagcctgttggcattcttccttaagtcgaatctccctagagcactggtgtacctgcctgtggctgtattaaaacaaattaagcttacttttgagatttttaaatttttttgtgtctcccacatgggcttatgtagtccgggaccatgttagctttttcacttcattatatttccacacctggaactctgtcgggaccctagttaggctctattaatatggattaaaataatgaatgagaacacctcctctatgcagcagttgtggaattctttgttaggattagggtggtcttgtttgcatctgctgtttccataatttttttagagcaacaatttactgagtgtttgttgtgtgttcgacactgttccaaacgctttagatgtagtagtaaacaaaacaaaaatgtcttcactcaatggaacttatcatggaatacagatcataggtgataaaactgagcataatatataagtaagctatactgcatatttgaagaatacacggagatttgaaaatggaaaattagagcaagttagggagtttggatgtaggtaaggagagttgcagttttaagtactttggttggggtagattctgttaagaaggtgacagtcaaaaatgtgaaggaggaatttagctttacagatacattggagaagagggggatttttttttttccgggcagaaggaacagttagtacaaaaggcctgctgctggaagcacatttggtattggagcaagtatgaagaggtcattgtgactggagccaagtgaataaagtcatcaagagagcagtagaagagggattctgagatgtaaaaggtggggaagggagtgtagattatacatactctctgaggccacaaaaggaatttgccaagattgatgtggaaaaatatttctgggtatttcatcagagtggcatgatgtggcttatacttaaatgatcattctggctgctgtgctgaagatagactgcaggggataagggtataacgaggcggatgagttaggaggcctttgctgcagattacctagataataccaggggagctgttgagaagcggctggattccaagtatatggtaaaggtagagccaaagggttttctgatggattggatgttgtcctgaatctgtaaatatcatttttaagctggtccaaatcacaagtcaatccatgaaaggttgcttctaaaatgttgaaaaattttcattcagttctactagttattaacttaatatctagaatgaaaatgttatgaaaaaaacctaaacaagccaaaaaaatacccaaaaaactgaaaacccaaaaaatacctcctccctaaaatgcttacttatttcttcaactgaatgaaaacccactgattttttaataacattatgcacatactctaagattggcaatagaggaaatattttcttatgcagaagcaagattctagtcatctctccacactaccctgacttaatttttttttttttttttttttttagaatattaccactgtcactgtcttcttgatttcaggaaagttgtttcttcctatttaacctctggcctaagaggaggaggttgggaagacacacttttcttaattctttttagcaacgtataggccaggtgaaaatatttcagtaagactgaactaaatgtttggagaagacaagaaaatataaaaacatgcaattagaaaaaatagtttacactacagagttttactcaactattccttgaggttctgtttttttttgttgtttgtttgtttgtttgtttgttttttgagatggagtctcactctgtcgcccaggctggaattcagtggcatgatctcagctcactgcagcctccgcctgtcgggttcgagcaattcttctgccttagcctcccgagtagctgggattacagatgtgtaccaccacgcctggctaatttttgtatttttagtagagatggggtttcaccatattggccaggctggtctcaaactcctgacctcgtgacccacccaccttagccccccaaagtgctgggattacatgcattagccaccgcgcccggcctccttgaggtcctggacagagaatattcctaccacagtccttggcttcatgtgaagtctttcatcccttcaccaaagaagagcctcaacttacctgggctccttggtgtctaagtcctatagagtgagactcaagaaagacaaaatgacttcctgctctgttatccaaaccctctttccaacttactgtttccccttgaaatatctgccttttccagtgtgatgaatagcatggcttttcagggatagagaaggataagaaagtgtctttactctgggccacccagacattcagtcagtacacaggacattaagctagcatctgtacaggagacacagggactaacaaaagagtgggtggttttaaaattgtatttaattaattaatttatattttggctacacatggtatttctgaggagatcaaggtgatttgcttttctctaacatagtgtgaaaattaatttgtcttcacagaattggaaaaatgaatgtaatttgacatatgtcttgagtctggttggcttctgaggaacttgtgtgcatctcatcagtatgcatcttaagaactgaaatgaccctacttcagcattgtgagaagacatgcattctcttcgtataaataatgtggatcttacatgtaaagtattataaagattagctgtttaacaacttaaataagcttgtgaataataaattaataacaatgttatgctaatacgtaactatgatatttgctgaacaaaataaatttgcctactttggaagcagattgggtggtttaatatatcagcaaaagagtgtttttaaaaaatatcaaagttctgttaatcaaaacgtttattgtaggacagttagtaatgttttgtttgccaacttatattacaaagtctctgtcttaagtgtttccttgcaaataaaatgacaatactgccttacattttattactttagagtttgcaaaatatcttcattataatatttcatttagtagacatgcctatgggaacattacttccagaattaaaaacattatttttgttttggtatatttttaaactacaaatgatagaaaggcaagtaaatgtaagtttttctctagttatttgttcaaatgctaatttaaaacatttgtacatttctaatacaaacattccttatttgagaaaaaatggatttcttaaaaacaaaatgcattttaaagcagagagacagggcattgagctgaaaatggtggctggaagttgggatctgtaagagaagttgaatgtgccccgaggcataaagctgctaattttgttttattggattttactgtagctattaatatattttgctggagatttatgtgatcaatttatcttatggccagaactaattcccttagtatattttattagaatatgtgactttttctaaatttagctttatttttcatattttccataaatggcaaagattctatgtttccagacatgttaagtattgcaagaattattggagcacctaaagataaataatatcaaaatagtgtcattgtttcccttagtttctccttctcccccacaaataaaccaagaggtatttagttatactattgcatgtctctagctttattggattcttccatgaaagaaaaatggattacatttttggttgtgtggccctcgttgccctattgcacttttgataatatttgcctgtgacaagtagttatttttcattaccacattcaatcatgggtaataaaatattttaataatggtgaatgtgaagttaattaataacccgcaggtatggcagctagacaggattgctctccatctcaaacacaaggaaaacaattccatcggtagttataaatttgcatatgaatgtcaaatatatgaggttttgaataaaaatcatttctgagtaaaagtgtacatcggcaagctgtatttaagttccgtatttatagataaattatttcagaatatgttagttactatgaatcataatcagagttcttcagttagggaactcttgtagtgcgtcagtaggtatcaatattgaaatatttgatattatttaacatgttttgcaacttagttgagtgtatatatggttttacatatatttaagacatatagattagtgaaatttattttggaatgagttgttgctttatgtattataaatacagaaatattatgcaaagtaattttaggtttattggcatgcagcatatctatatcttccttccttctttctctctttggttccttcctctcttccttcccctcttttttttttttttttttttttgaaacacagtctctctctgcacccaggctggagtgcagtggacctatcacagctcactgcagcctgggcctcccaggctcagatgatcctcccacctcagcctccagagtagctgggactaaaggcatgcactaccacacctcgctaatttttttgtattttttgtagacctggggtttcaccagattggccaggtttatctcaaactcctggcttcaagtattccacctgcctcagtctccccaaatgctgggactacaggcatgagccaccatgcctgcctggcctcttcttccccgtctcaatcttccttccctctttctttccctctctctccctctctcttcttcctcttttctccttcctctctccctccctcctttcttccttccttccttcctactttttctttctttctgccttctaatacccatcttgttttttgcaaagtcagcaaaaaccagacaaaataataaaatctttagtaactttttcaaactcattttcatgtattctcccatatgtggccttctagaaaaaagaaaaggccattgaaagagtggaataatattattcttcttcttctttttttttttttttttgagacggagtcttgctctgtcacccaggctggagtgcagtggcgcgatctcggctcactgcaacctccgcctcccaggttcgcgccattctccttcctcaggctcccgagtagctgggactacaggcgcccaccaccccatctggctatttttttgtatttttagtagagatggggtttcaccatgttagccaggatggtctcgatctcctgacctcgtgaaccgctggcctcggcctcccaaagtgctgggattataggcgtgagccactgcgcccagccgagtccatttgggaatggctcaagttgtttaaccatgtgagacatagaatttttgattctctcattctgttatagatgcattgcttgtgttgctcaatctattctttttaggtatgaaagggactatcattgttattgtttattacttattaggagaggagcaggtgatatagagaagtaacaaggcctggtcagacagggcccttccttgtgggacctttgaaaggctttcatttttactgtgagcaacaaggattgtgagcagaagagtgacatgattggaattacattttatccctttggccactgagtttctagctcactattgagggaagggtgaaagcagggaggccaatttgaaatcgatgaaataatctaggcaagagatgatgcaggcctagaccaaaatagttgctgtacaaatgccatgaaatgctcatatttggtgggatatggagtgaaggtaggagcaaaattttactgacggactagatatctgtccttagagaaaagaggaccctggatattttcaagacttttaccctaaactactaaaaggttagcattgctgtaaaataagatcagaaagactgcggcaagacagatatagggaaagatcaaattttcagttcggaagattttgaaggtggactatctcttagccatttatgtggtgatcttttctaggtagttggatataggaattttgagttcaaggggcagttctgtctgggagatttaaatgtaggaaacatcacttaacagtgtattcataaatcattatctaggtgaaattacataaagataaaaggggatgcactgaacctgatggtactttcctgtacaattgagaaaaggtgaaataagcagaagaccaagggatgcattgggaggaggagaaccaggaggaggaccacgtaatggaagccaagtgaagacagtgtttcccagtgctggtgagttaagtaagatgaagactcggacttgaccatgtagccatgtggagggtattgatgatttctggttccccagaagggacaatagaaataattacatatcgatagaggaatcctaaaattacactttgtgattttcctcaccttgagagctcttatatctctggcagtgtctaaatcttttatagatattgactcatttactcatccatataaactgtaaagtagaatcccttattatcctcactttagagatgtgaaaactgaaatcagagaagttaaataattgggccatgttattacatggccagaaagtagcagagctaagatttgatctcaattgttctgattttagagtccacagtcttaaacactgcactatatactagctatgaaataaaggaaagttaaacatgatttatatatgatcctaagtagtagaatttatataggatttttatatttttatgtgatctatattacatattattctaagtagtaggataaagcaaaaatggctgccatgtgatcatcaaagaatgctaagttcagagtgttttagtatcatatatttttttctaaatattttttcctttaataaagagttgagccattaactattaggcattgtgtttttgtttgtttgtttgtttgacagaggtcttgctctgtttcccaagatggattgcagtggcctgatcatggctcactgcagcctctacctcccaggtttgagcaatcctcccacctcagcctcctgagtaactgggacttcaggcatgtgccaccatgcctggttaattttttaaacttttagtagagacaaggtctccctacgttgcccaggctggtctcaagctgctgaactcaagtaatcctcttgccttggtctccaaaggtgctgggattacaggtgtgggccactgtgtccagccagcactggcttttaataagtgtcactgaaaagtaagtcggtaagaaacaaccctcatctccaggtggtagtaactgaaaatgaaagtaacagaaagtgagaacatggggtgtgattcttgtagtctgtattttgctggtttttattagttttgagcctcaatttgaaccttttgtactggaatctaaagatgaagtttccctgatggcaaaattacaatccatcactcactaatgtcatttcttccatgagtcacatccatcctgaaggaaagtgcttgaactaggaacatgtacctttattacatgtaggagcaaagaccataatcctattatttacttcacccccatctaatgcctcttagtaatagggatgtttattattttttaaaccagaagttcactttctcgtatccatgtaagtctgtctagttagattggagtaaactgaatccacttctggccaactcaagatacaattgaaacttaattgaatacaaccatgcaccggtcataatggtattttggtcaaggatggattgcatatacaacagtggtaatataaggtaataatgaatggagttgaaaaattgctattgctaatgctgtcatagccattgtaatattgtagcacaagacattactcacatttctatagtgatgctggtgtaaacacacctattgcactgtcagtcatataaaagtatggcaatacaattatgtacagtacaaaacacttgataattctaataaatggttatgtatttattatacaaaactttttaccattatcttagagtgttctctttctacttagaaaaaagttaactctaaaatagcctcaggtaactgtaaacagcctgttaaatagcaagtccttcagtaggtattccagaagaaggcattgttattacaggagatgatagctccatgcgtgttggtgccctgaagacttacaagtgggacaggatgtggaggtggaagacagtgatactgatgatccttaccctgtgtaggcctagactaatgtgtgtgtttgtgtcttcgtttttttgttttttttttttttttttagacggagtcttggagtcttgctctgtcgcccaggctggagtgtagtggcgcagtcttggctcattgcaacctcctcctcccaggttcaagcgattctctggcctcagttgctcaagtagctggcgttacaagtgcatgccaccatgcccagctaagttttgtatttttagtagatacggggtttcaccatgttggccaggctggtcttgaacccttgacctcaggtgatctgcccacctcggcctcccaaagtgctgagattacaggcatgagccactgtaccaggcttacatcttagtttttaataaagaagcttaaaaaataaaaaaatatgcagaagcttataaaataaggatataaagaaaatatttttgtacaggtgtacaatgtgtttgtgttttaagctaagtgtttcttcaaaagagtcaaaaagtttaaaacattaaaatgtttataaagcaaaagagttacagtaagccacagttaatttattattgaagaaagaagaatttttaaaataaatgtagcgtggtctgagtgtacagtgtttacagagtctacagtgttgtacagtcatgtcctaggccttcacattcactcaccactcactcacttgcacacccagggcagcttcctgtcctgcaaaccacattcatggtaagtgccctgtccaggtgtaccactttttatcttttctaccatatttttactgtacattttccatgtttagataagtttagatacagaaatacttactattgtgttccaattgtttacagtatttagtagagtaacctgctgtacagatttgtagcctaggagtaataggctataccatatactaggtgtgtagtaggctacaccatctaggtttgtgtaagtacactctatgtggtttgcacaatgacaaaattgtctgaggacacgtttctcaaagtatatcctcatcattaagtgatgcatgattatacttgagctgtagaatgctgattacatcatttgccttgatctcaaaagctcattgaaacttcctattctttcatgagttatatccatttttttcaatcaaaacatgaaatactccatcagtctgtatccgaattaactatattgtctgctgtttccttaaaatgaacatattttcaactcactgcttcagtcagccttaatctttgcttaagcaatttttttccaatctctattccaatcatagtcatctttctttttcaagtctttcattaggagaacttttttccttagaattaatcacattatttcctatttctgcctcagtgtttaaaaacttaatatctacagattgtattgtacttcactgtgtataactaaattatagctacagcattttaatccactcagacctactatgacaccttaagaaattgaacttctgggccgggtgcagtggtggctcatgcctgtaatcccagcactttgggaggccgaggcgggcggatcacctgaggtcaggagttcgagaccagcctggccaacgtgatgaaacaccatctctactaaaaatacaaaaattagccaggcatggtggcaggtgcctgtaatcccagctacttgggaggctgaggcaggagaatcacttgaacccaagaggtggaggtttcagtgagctgagatcgcaccactgcactccagcctgggcgacaagagcaaaactccatcgcgaagaaaaaaaaaattaaacttctggtgtgtaacagggagttattgagaaattcaaacaggtaatgatgtttgaggtttttgaaatgtgagtgtaggagcggtatagtgtttggattggaggagggatagactggcctcagggaggccagttagcacaagactgaaatagtattgtcaaagaatgattagccctgaattacagaaatagcagtaggagtgggaaaatactgaaaacatttgggacatgtccaaaacactaaacatttttctctattattctagcaggctggaagacatgacaagtgaaaatctcccctctagaatccgttttcgtcacctctactattgtactgctggtttcacatatatcttatagattgagggagttgggctgggtggggagacaggtctcttttctggctttctaattctgctgtatatcctgcaatggcttaatttatggtggctggcttcatattgaacaaaggccctgtgaccaggtcattttctgggagcagaaagacaaagaggaatttcgttcttctccctaaactcagcactgcatcaaccttgatgccatctatttaatgggcatagtttttcaaccttgtttattatgacgaagtttcaattgctagacccatttaagacttgtaggaacagaatgtgtcttcttgcttccaggacggagttcctctcctggtttcttcaagactttatttctagttcaattccaacaccctgtgcactgggactctgctgctgagtaataatgcctgtgctcttctccagtcacaggcccttgtttttgcatttcacagtaactcttctgtgataattgcaaggtcagattttctgatcattatctgctgctgacttgtatttatttcttcacttatgtgttcaaatatgttcagttatcaaaaacctattttgtataaattactccactggcatcaaggagagaatgcatagaaataaaaaaattccctgccctcagtaaacttacacactggaagagttgactgaaagttggtttcactgcctttccagtctgacctgtgagagattaccatagattcttcactctaagttcttctatgaaaatattacatatgtaatacataaaaatataagtttttatataaaaatgaaaatagagaaagtagaataaaaaagtagaagctttctccactcacagatgcatatacaaacatacccgttctttgtagaaggaaccattctgaagaatttcatgtgtccccctacactactttttctttggctttagaaagtatatatttatgtatattaaagcatatacatttttatacataaatgagtttatattactatagagcaattctacttaaagcatgctttcagatttcaatgaaactttgttttagataccttctgttaattagattttgcaatactttaaagttaatcaaataaggcaggcagtgccacctaattataaaaagctaataccagttctaaattatgtgctaatgctattctaatataaaatacacattaagccaaactcaaaaactctacctcttaaattattaattaatgtgtgatgctggttaaccagacaatttttacattgatttgaactcaaagaaattatctatgtaaagtggcttaaagtggaaaagtctccttattttgatatcaaagtcgtagggaggtgataaatatttttgatgtctttggaaaaaatcaactcaataatgatagtattttaatttgcagtggactggaattcaaggttccatataaagaactgtggttgtttataaaatagtcagaatattgtggaacattgtaatatgcaatgatatggcttttatgcaaactaggtacaagctgatggctctttcctttgtgattgaattatttgctccacatatagcctgttcaatcttgaaaattaagtcaaatcccaagtattttctcttcccctgatcacttagttataagaaatattcgtatattctattgtgcatttcttagttttgatcttcaaccttaaataccttggctttgcttttgttacatagttttaatttactgtttaacttgaattatgccattatactaaaagggattaaagagaatatagcaaattaaagtgtggattggatggtagctgttttaatgtaataccaaagctgggtttccacaagtatttccttttatttctattttgttccttttattgcattaatttaatttatttgcttatttatgtattggttagctttagtgatatttgttccttggcaactctaatttatatagcctgtatgtgagaactgagaatgaaaagaaaaaaaaagaaagattgtaatagaaaggagagcaattgtgtacaactggaacttctaatattcaatgacgttacaatttcaggtttatattaagttctcagattagaattttatataaaacattgatgcctattaaaataattatttgatatggaaatgatacattagtataaattcttgaattatcaatttataaggttattagttggataaatatttataagataatatcacatcatcatccaataattgtattattttacaacttctctaacgtaaccactgaacaccctaagagcctgctgacatgggtttttatcatttctataatctagttggatgagtaatgtgctaatctttgatgaaaagttatgcttctttttagggggccgcagatggtgtggaggtagattgattaatttgtgtcatggttttaaacaaggatcaggaaaaatatgttttcacaataaaaaacatttttcagaaagaaaaacgtatgtaagagtgagaatcgtatgcctcaatctagctttgagtttggaaattatacatcaagaacagagtggatagaatcaaggcaatatttaaggttattaaccataggaaacagataataaaatggaacaaagatccttcttcatggctatatatcaaataacatcattttaaatttgtatctattttgaattgctggtaatgctgccatcttgttgctgtactacaagatgaataaagagcctggaaatagtcaacatttattagcaggattttcaaaatatgttcttaaatttaaacttcatcacctttcatgtgccacttattatctcttttattatctacctcacctaaattctctggaagctgcttggtaaattaaaaggaagatattgagcatatcaataattttttagagcaagcattaaatccagtggtgtgtagtaatagatttttttatgggagatattatttagctttcccttattgcttctagttatttgtgttcaagaaaaatgtttagagaggttcaatagatgtctattgtcccccacaactctgacccccatactctaaaacaagaatatctcaaatctagggtgttgaagaaagaggaacaagagggtatcaccaaaaattttaatcacttatttgtatgttacgtttcacaaactaccttgagagacttaattttatataatgcagatgttagtagttcaatctctagaagcagaaagactggagtttgaaatttggttctgtcacttttccccagtgtgatcttgcaccagtgattctagtccttaatttcttcatctacaaattgaagaaaataccagtttttactttataaagttgtggtgagcatgaaataaatgttattgcatgtaaagtttatagaagtgtacagagaaggcatatcaaaagcatacatattagccattattttaatattctaataatttgttaacctaacttatttaccacctaaaaaatttggttggtttcccattgtctaccagacacagcctgagctctttggtggaccatttatgacactttatagtctgatcctgagctctttgttgtaccatttatgacactttatagttggatctaaacatccctttccattcttaccttctgtaagtaccaaaaaggatgtgggtgagtaaacatcacacacttttggatatagcttcacaacactattcatcatttctaagtagatcatttccaaatgacatgatctgtttgcataaaagtgatctttgcccatattgcctgctaaatgttttccacttgcctccactgggcatggattatgacttaggttaattcttaactcttcttgtaaacctttccttgttctgggtactccagtcataattaattagtttgtcttttgtgttcttatataatttaaaaaatatttatatttcagtgctataaccagtactatggtaatttgtaacaatttatctgccacaaaattgtaaattcttcatgatcttgaaaggttcaagctccatgtcttgtatttatcacagttcctaggacatagtaggcatttgataatgttttcagaaagacaaactcatggaaattaagaaaaatgggagacatattaagaacttaataaaatcttaataaagattactatgtactgaatgatggtggctcccccaaattcttatgtggaagccctaacccccaatgtgatggtgtttggaggtggggcctttgggaggtgattaggtttagatcttgagacagagagccttatgatgagattattacccttataagaagaaggagacagagagctccttggaagggccatgtgaacgcacagctagaaggtagttacaagctgggaattagaccctcatctggaaataaatctgccatcatcttgatcttggattttccagtcaccagaactgtgaaagacaagtatctattgcttaagacatcaagtcttggtattttgttttagcaccccaagaaggctaaggaaaacatattatttggtgttttcatattaggtagagaaacattttttagatgaaagcatgtctattttgggactgggatcctcaaacagaggatatcactgttttaaaatttgaaaactttaatagaagttaatataggcaaaataaaagaaacatgttgatgatcaagtgatcaaggcaggctggagtgaggtataagaaacctagtttataatacagtggatagtaaataaatatttgtagatgactgccccataatgaatggatgcattgattaataagtgaaaacctagtaggcctccctctactgaacttcagtgttggcatcatgagatgtctcacttttaaaaaaatgtttcccattaagtttctcttattctttgtcagttgaagaatattaagttagttccatcaggtttaacctcacaaccttgcacatttctgtagttattccagatatgaagttctgttaagttagtctcctagcaagctgtccattaattctgaattcagaccaaactttaaagttatcaataggaataaagctaatgaagtctatagttccaaataaaattgatgattatttgttaaattaccaagagaggaatatccaaaattttcaaggcaattatatttatgtacatgcatttgaccacagattttgagacaggtacttcacaatatcattgcattttgaacgattaactattcatgatttcatatattcacgcattatcaggtcatttattttaattaaaataatgtaacaccttccaatgattaataataggatgtttcacaaaagtaaattctactttattaaaatcataaaaattatagtaatagattaatctcctccataagttagctgcataaagtgccttcaccaataaataaaactgttcattttcaagatttggggtttgtatttcttgacattatgaaatagatgcttccttttttttggccctatacaagcaatttattgaaatctgttagaatttgagctaagtctgtattgggcttattatcctgcctccatgcttgaaaaaaaaaaacaaaacaaaatacagtttctttaaaatagttgctctgagattacttccaacttccatatataacgcgtgtcattattttttacttactgcttcataaatcaaccttttttctatttttcctctcttttataaaaatcatccaggtctataatacttcctccaattcttgctctaagatgggatctctgtgtattactaggaaaaatacaactgtaatttagtatttattgcaggaatgacaactgaggaataaaaagcctctaacattgcatccaaataatcccagatgaggatcattttcatgcttaataagtagctctattcactatatcttgttttgtttgtttcatatttttcctggtgtggcggtcttgtaataatttttggctctaaagtatgctgttgtttggttttaataagacatcagcttgcagtaaaactgaacagatgcgatttaaagtgctgatctatcttgcagatccccataaacttgcattcctatttcataggcatgaataggaatgaaacccagtgcaattgtaagtagaataatctatttctaagtttttataccccaacacccctacctcctcccatttttcatggcaaacattttctttgataagaaagccttcattgtaggaaacaatctctcatgggctgatttatctggataattttttgaaaactcatgtttaccatgacagactctgcagattacactgggctgagagtcaaaatattagcagtggatttctctgcatagtagacattagtacaccttttttgttcaatgagctactttagcatatgggatgtaaagttccactatgtgattatgtcttgagctagctgagttatagacagttcaagtactttttgatagcggatttttttttttttttttttttttagatggagtctccctctgtcgcccaggctggagtgcagtggcacgatctcggctcactgcaagctctgctcactgcaagctctgcctcccgggttcacgccattctccttcctcagcctcccgagtagctgggactacaggtgtctgccaccacgcctggctaattttttgtatttttagtagagacggggtttcaccatgttagccaggatggtctcgatctcctgaccttgtgatccgcccgcctcggcctcccaaagtgctgggattacaggcgtgagccaccgcgcccggccttgacagtggactttaaataacccagctcagagcacttaacatgttctactgacttcctgagggttacttactcacatattttcaacataggcttaatgtagcatcatgaaaggaccatacaaaaatgctcaaagattgtttctctaagaacatgtttggatatttttaaaggaaaatatgcttattataagtgttagaagttgttatagcacgtgccttgtagtcccagctactcgggaggctgaggctggagaagcgcttgaacccgggaggcggagcttgcagtgagctgagatcgcgccactgcactccagcctgggcgacagagtgagattccgtctcaaaataataataataaaaaattgttataccaaatatggaatcggtttaccatgaaattctaagctgctgaattggggaggggcattcattgtgttactctggaaacatcacaattattttttaaaaaacttttaagttaaattggttctggcaacttttctagctgcctaaaggtaaggtgtcgtaaacctgtcggaaacagtgaataagtgacagcaaatttgggaatagaaaaggagaaaatagtgatcctacagattgagataagtataccagatatttgtcagcattcaggaataccacatttattcaacagatgaaaaactcacataatccagtggtttccaatgtcctctataacaaggcagcttgtgtgagactaaccctcccctaaaaaatagaaaagattagtacgtgagtccactcttttaaagcattagggaaccaccatggcagacagaactacggggctacaaattctggaaacaagggaggcagatttatgtgagtcctatatttatctatctctgagattttcctcagggctttgtcaatgccatgggtgaggtggcagagcagaagtcgaaagcctggggtcacgaaagtctcattgtgctgaggaaacagaaggtggcgtttggaccctccaagaacaattgaattttagggaaaaagtaactgcagggaagtgagagactgcgtgaaggcctttggtcacttcctccacacctccttccaccacacacttcctgtgtggtgttcaggaaaagacaccagaaaacaaatagcaagccatatttgagatctaaagaattgaacaaatattccaacagtcttggttatagggaaaatgaagcaaaagtgtagagatgaacaaattgaatgacccccatgagcactcagctttcaattaagatcgcagaaaggatataacctaagagcaaggtttatgccttagaggtaagagttgaccaaagaaagcccaactttaagaaagcttcataccttcctttgactagatcagggtgatctgccaaaatactctaggcatgcacgaagattagccctcttttgagaaagagtataaatcagggactccccaattattatataccatgtatgtcattaattaaaaatgaccagacatgtctataaaatgtatggaaaccaaaattaaaaatacagactatcaaaatagatccacaggtgatctaggtagtctaattatttataaataagggactttaataatgattattaagttaaaaaataaaagatgtagacttattggaggactgggatctataagtcaacttatcattttcaaactaaggaaatagaataattgaatataagaattaaaaagctagacttattaatgtattaaacattgcaggagaaatagcaaactgaaaaaagtcagaatacttgaaacacgtatagaaataggatgggaaattcagaaaggcatgtaaaatttagggaatacaatgaacagatcttttttaaaaatgtaatttgagttccagagtaagaagactagggcagaagcaatatttgacataatatttcctgcaaatttaccaagataggcatagacatcaaatatacaatgcaagaagcatgatggaccccaattagaagaaatacaaagaaaatcacatgtaaatgcatcatataaaatagctgaactaaagagaaaaataaaatcttcatagcagccggaaaaaaaaaatttcccttaacagagagaaagaaagaaaaaaagagtggcagctgtttttttagcagaagcaatgaaagaaagaaggaaaaggaatcacatttttcaagttctgaaagcaataactgacaatggagaattccatattatgcaaaatattaaccaatcttgtgtaacgataccagataccagataaagtagtgtttatggtgagaaatagtataagaaatacgtaggcatatttcattatgataaatgtatgaattcaacagaaagacattacaattctaaatttgtgtgtatgcaatggtagtttaaaatatacatggcaaaacctaacaaaagttaaagaaaaaataacaaggagataaaataacaaggagattttaacattctcctcactcatgtatagtcattttaacagtcttctctcaatcgtgtaaaacagatacaagtcagagttaatttattagtgtggtagggctgccataacaaagtaccacaaagttggtggcttaatcaaaggaaatgtattgtctctcagttctggattatagaagtttgaaatcaaggtatcaaaagggttgggtcttcctagaggttttgtgggacatccacaccatagaataacaagcaattcaagaagcacaattaaaagaaatgtaaacaaacaaacaaacacccaaatgcatcaaataaaattgctgacacacacaattatacgttgagatgtcaagggaattttgaaaaagacattctcaaaaggttatatgtgattctatgtatataacattgtaaaaaaatgacaaaattatagacatgaaaaacagattattgtggccaggggttaggagatttgagaatgggaggtggctttggctataaatgtgtagcacatggtcttttgtgatataactcttggtggtcacatgaatctattaaaagataaacttacatagactcaatatatacacaaagtgagtatgtgtaaaacttgtgaaatcgaaacaatattggtggattgtatcaaggtcaattttttttatattatactctgattttatacagtgttatcattgggggaagctgaagaaagtttatacaggaagtctctgtattatttcttaggactgcatatgactctactattatctctggatgcaagagttagaaaaaaatacaacattcagagaattaaaagacaagcctgaggctaggtgtggtggctcacacctgtcatcccagtactttgagtggccaaagcaggcagatcacctgaggtcaggagctcaagaccagcctggccaacatggcaaaaccctttgtctctactaaaaaacacaaaaattagccaggcacgttggcgggcatctgtaatcccagctgctcgggaggttgaggcaggagaatcacttgaacccggttggcagaggttgcagtgagcagagatcactgtactccagtgtactctgctgtactccagcctgggcgacagagagagacactgtctcaaaaaaatccaaaaaacacaagcctgagtgggagaagatatttgtgacacatacataacaatgataccacagccagatctatctagctctagatctaaatcaggacaataaaaattaaaccgcaataaaataccgttacaaacctaccagatggctaagaatgaaacaaaacaaaaaattaaaaatacgcagtgatatccaggatgcaaggcaactggaaatcttacacactgctgatgggagtataaattaattgatgcaacagctttagaaaatcctttggcaatatattcaaagctgagcatccccatattctatgacccagcagttccactcttccatatacacccaacacaaatgagtccatgagatttatttttagcaatttctatatctcatataaattaaatcatgggttagatattgatgtaatctgacttcctttattcaacattatgtctgtgagattctctctggatgttgagtgcagtagcacaatcaaactatgtgtctttcacggctatatagcagatttgtcaaccgtggtactattccaccttttggactggttaattctttattagtcaggttcatcctatgtatgttaagatgtttagcagcttccctggcctctactcattaaatgccagtagcagccccctcaagttggaacaatcaaaatatctgtagacattcctactttcaaggagggacaaaattggctccagttgactatccaatctgtatagtattcggttgttggaatgtatcatataactacccactttactgcagtgcaagtttggttgattggggttttggtaacagtatggatttattcaagtgaataagtttactcaaattatcctgaggataaagtggtttagtgtatagggtttacacaacttttgtgagaactttccagggacagtggggaagcaataatgatattgtcactaaatgtaagcactcgtgaagaagaaagttcaggaagttcagatgctggagacctcaacctggatcaccaaagcaagtatttctcaaaggtaccaggaaaattgcatctttatgtagtttattaaggaaaataagaattttcctcaataaataaaaattattgaacttcattactgcctttttgcacacagaatttcatgtgaataaaaagtattggtcttactattggaggcctattaccatatcacagctaaatgcaaaacaaaacaaacatatatattggttgacaacatttatttgaaaaatacaaaataaggtaatctttaaaaaacatggttggcatgattagattaaataagaattttccttaataaatcttgtggtaagagtgcttgtcttatatatggtatttctaggaatgtttataagaaagggaattacgtcatttggtgaaattatataaaaaataagtacctggggaaatttatgaaaaattataaggtgttacactcataaatgaagtatttcttccccaaaagatttatgtctgtagctttggttacacagtgcagacttttaaaatatcgtttttgcttataacttcatctcaaaagatttctaccaagtaaaaaaatgatatacctgttataatagtgatgatctgcatatataaaattatagccattcaactgttattaatggtgctttgcattaggtagtgatgaattatgatagctgccttatttcctaaacaatcccttccacatataactaaactattttaataaaatcttgatcatattaaattttctttcatgtatgcatttaaggaagtgtcacaaaagcacaaaattatatattcacacaaacacacacagataaaacataaactgaagttgtgatgaattaataaaaattattgaacttcattactgcctttttgcaaacagaatttcaagtgaataaaaagtattggtcttaccgttggaggcctattaccatattacagctaaatgcaaaacaaaagaaacatatgtattggttaacaacatttatctgaaaaatacaaaataagtaatctttaaaaaacatggttggcatgattagattaagaatgattaggtcgggagcggtggctcacacctgtaatcctagcactttgggaggccgagcggggcggatcacgagatcaggagatggagaccatcctggccaacatggtgaaaccccatctctactaaaaatacaaaaattagctgggtgtggtggcgtgtgcctgtaatcccagctactggagaggctgaggcaggaaaatcgcttgaaccggggagtcggaggttgcagtgagccgagatcgtgcctagcgacagagcaagagactctgtctcaaaacaaaacaaaaccagaatgattataagaaaagggctttctgtaaggtttgactactgtcatctaaactaagataattacggttaacacacttgtgtgcctgatagctaacaaaagcatttagtcctctaaggactgagacacaattcataagttttgtttttgtttcttgtttcaatttttaaaaatccaggcataataattgtacctatttacaaggtacatgtgatattttgataagcatatagaacttaacaccgatctgatcttttaattgtttccaggcaaggagcaggctccatgcatgcatttgggctctgtggaaaatctagccagggatgcgggcctttctgaacgccgctttcattgtgccccctgcagcattatctcttcgatgcgatgtccctgctgactgaaatgcagagaagctactaagatccacacaccagttgctgcaatcggtgccctgctctttgtcccccattcaccccaggtgattcagctcttctggcactcccagtgattcctgtgggacaggcccagagtggacttcccacgaagattcccagactgggggagagctctaagatccacttccaattcctttgtctcacctaggagactctgggtttatggaagttctctctgattagtgctgttgcagctgggtttgggggtcatgtagtctaaatgattgtttctcttactggtggtgatttttccagtttctgtgggcccagtggatttctctgcttctccttagagttctggtgaactcagaatgttagtgttattcttttctttgaaaatagtttccatttgtaatttgcttggagagtgattctgggggattctattctgccatcttgctgctgtcactctttaataagatttgtaactaattctcaaattgttcatagtcttaaaactacatagagttgatttcatacattttattatgagaacaataaaagtattttgtgtctttgctagtgagatttttagttatacagaaattacagtgtttcctgctatgttcaatcattccaagattcattatacatatgttaaatatgttatacatttgtttacataatgcatattttattttttttctgagatacccaaagcataatctccctcactatcctgaataattataaattagtatttcatatatgatagaaaatttgtgacatccactatttttaagaacggctaggctgggcgtggtggctcattcctgtaatcccagcactttgagaggctgaggtgggcggatcacgtgagttcgggagttcgagaccagcctgaccagcatggagaaaccccatctctactaaaaatacaaaattagccgggcgtggtggcacatgcctgtattcccagctactcgggaggctgaagcaggagaattgcttgaacccgggaggtggaggttgcagtgagccgacatcatgccattgcactccagcctgggcagcaagagtgaaactctgtctcgaaaaaaaaaaaaaaaaaaaaagaagaatggctaatttcagaacatgtttatatgtatgttgtattcaatgtctttaattaaagtctgtttctttatcctaatttgtgtggcaaactaatatttaccataataaatggcttgaagaataaaagtcaattagcggctatatttgttaaatgttaaagtattttattttgtctaagagagggttacaaattaaaatatatttaataataatcgccttagtaattatatcgatttaaaatacatactagataatatacttaaatttatttttgagactatgtcatttttgacacagtcaaaaacaaaacaccttgtagagatgtcatatgatgattattcatggttatttaaatgtaaatatccacacatacacaaaaatgcccaaagaggtcatcgcaaaggaataaattgcatcttactaagaagtaaacttagagctcaggtctatatttttatcagagaaaacaaaaatcaatatttcagtatgtgtctgtgtgactacaatacagattcatcatcacacatttaccaagtctaataacatccactttgggttactcttacgtatttatttttacaactgtaagatgtggtagagcttcctcttttttgaatgctagtcatttaatatgtattttttccccaaaattcctgcttctcaggccttggcgttttttttgtttttgtttttaataccaagagaatgcctttagaggagcactgaatatacagaaagctctgatgccccattctgaccaattcacctttaacacttcctttctcattcaacaaattcatttaaatatttttgaacaattgtgtacttttcaggttgaaggaaacatatttatttttaggcaggaagactgatgcaataaatatttattaaaatatttttctctccaggcttaaacatgtctgtcagttgatgaaattcagggtaatctttgcaggatgaataaaatgacctagagattctgtcaatgttctcactctccgtgacacatttttatgcctagcagagtcatagactaaattcttatgaatcagttttatgaaataccttaatagaagatatggtcttcttctattgtgataattcatgacaatatagtaaatcagagggagccattacatcttatcagcaatataggagcacctccccttactggccagctatgcagcttctacatgatgttaaatgattgtgcattttgaaaacatcctcagagaaagcctatacttggacatctttggagttaacaggtattgttaataactcacacaatagtaaaactctgatggattgattcttgaatacttgtttcccagacacaacaacagtgttcattttccaacagtaaatggcaaaacaaaacaaggccaactaacacacttccaaaccaaaacccacataccctgaggttctctggtgactcttcagaagcagatggtccacaggaatagacaactcgggataagccaataaccccaccgagcagactccttccgccaaaggacctcagaaaactgccttgatccagaagcctctaattgcaatacgcttatttgcaagtttttgttctttattctctatattctttccccctactggaaaaaggttctgaatttttagcagatacccctctcctgaagtcatagtactgcacgactcattgataatgaccaggttatgtgaattcactgtcacaccagatgacggaaaaaagatcactaaagaagaaacaacatgactaattccacttgaagaggtgaaaatacactgttacaacatgatacaagattactaaccactgagtgaacagtgttgcaagtttggattgatcatatccccaggaggggatggtttgtcctttagcttagcctgaaagcccaccagatgcggaactaatgaaataaaaaagtacctggtgatagcaagggtatgcatacgtgggttgagggtggggatgagaacttaagcagaaatcatgacttgcaaaatagactgatttattattcacaaaataaatctatcaaacaaaaccataatatacatgccacactatctgtaattagattttttaatatcagctttatcagacccatatgctccaggaaatcaaagaacaacagaaaaacttccctccatttctacatgaacccatgtactctaatggtgagatcactgactagtccagcactttgcctatttcctgtatcttggagaatccttgccaaaacaagcttatgattaacttcagcctgtcaaattctaaaatagcttttccttagcttctcctatgaaatactccgtgatcattcatgtgtatgtcattctttgctgcagcaggctacataaacctatgtcttttgagttacaaatatcttctcagtggtctttagttggaggatctgtcattagtttaaaaaggtaattagtttttaaaaattgttttgaaaaagatatagatgagatccaacactaccatttcaaatttttatttaaatggctagagaatattatatcgatttattttacatagttttctcttacagcttttaattaaatctagatcctggtgagtggaaaattagacagttttagagaatgaataaaacaaaaatattctaaatatacaatcatatcatctgcaaacagagacaatttgacttcctgtcttcctatttgaacaccctttatttctttctcttgcctgattgccctggccagaacttccaatactatggtgaataggagtggtgagagagggcatccttgtcttgtgcaggttttcaaagggaatgcttccagcttttgactattcagtatgatagtggctatgggtttgtcataaatagctcttattattttgagatatgtttcatcaatacctagtttattgagagtttttaacatgaagggctgttgaattttatcaaaggccttttctgcatctactgagataatcgtgtggtttttgtcactggttctgtttatctgatggattatgtttattgatttgcatatgttgaaccagccttgcatcccagggatgaagccaacttgaccatggtagataagctttttgatgtgctgctggatttggtttgccagtattttattgaggatttcgcattgatgttcatcagggaaattggcctgaaattttcttttgttgttgggtctctgccaggtcttggtatcaggatgatgctggcctcataaaatgagttagggaggagtccctctttttctattgtttggaacagtttcagaaggaatggcaccagctcctctttgtacctctggtagaattcagctgtgaatctgtctggtcctgggctgttttttctgttagtaggctattaattactgcctcaatttcagaacttgttattggtctattcagggatttgacttcttcctggtttagtgttgggagggtgtatgtgtgcaggaatttatccatttcttctagaatttctagtttatttgcatacaggtgtttatagtattctctgatggtagtttgtatttctgtgggatcagtgctgatatcccctttactattttttattgcgtctatttgattcttctctcttttcttctttattagtctggctagcatctatctattttgttaatattttcaaaaaaccagctcctggattcgttgattttttttgaaggttttttgtgtctctatctccttcagttctgctctgatcttagctatttcttgtcttctgcttgtttttctccttaagcttataagcagcttcaacaaagggtcaggatacaaaatcaatgtgcaaaaatcacaagcattcctaaacaccaataatagacaaacagagagccaaataatgagtgaactcccattcacaactgctacaaagagaataaaatgcctaggaatacaacttacaagggaggtgaaggacctcttcagggagaactacaaaccattgctccagaaaatgagagaggacacaaacaaatggaaaaagattccatgctcatggataggaagaatcaagatcgtgaaaatggtcttactgcccaaagtaatttatagattcaatgctatccccatcaagctaccattgactttcttcacagaattagaaaaaactactttaaatttcatatggaaacaaaaaagtgcccatatatccaagacaatcctaagcaaaaataacaaagctagaggcatcatgctacctgacttcaaattatactataaggctacagtaaccaaaacagcatggtactggtaccaaaacagatatatagaccaatagaacagaacagagggctcagaaataacaccacacatctacaaccatctgatctttgacaaacctgacaaaaacaagcaatgggggaaggattccttattttataaatggtgttggaaaactggcctagccatatgcagaaaactgaaactggaccccttccttacaccttaactcaagatagattaaagacttaaacataagacctaaaatcataaaatccctagaagaaaacctaggcaataccattcaggacataggcatgggcaaagacttcatgaataaaacaccaaaagcaatggcaacaaaagccaaaattgacaaatgggatctaattaaactaaagaacttctgcacagctgaagaaactatcatcagagtgaacaggtaacctaaagaatgggagaaaaaattttcaatatatccatctgacaaagggttaatatccagaatctacaaggaacttaaacaaatttagaagaaaaaaaacaaacaaccccatcaaaaagagggcaaaggatatgaacagatgcttctcaaaagaagacatttatgtggctaacaaacacatgaaaaacaactcatcatcactggtcatcagagaaaggaaaatcaaaaccacaatgagattccatctcatgacagttagagtggcgatcattaagaagtcaggaaacaacagatgctggagaggatttggagaaataggaacacttttacactgttggtgaaagtgtaaattagttcaaccattgtggaagatagtgtggtgattcctcaaggatttagaactagaaataccatttgacccagcaatatcattactgggtatatacccaaaggtttataaatcattctgctataaagacacatgcacacgtatgtttattgcggcactgttaacaacagcaaagacttggaaccaacccaaatgctcatcactgatagactggataaagaaaatgtggcacatatacaccatggaatactatgcagccataaaaaagcatgagttcatgtcctttggagggacatggatgaagctggaaaccatcattctcagcaaactaacacaggaacagaaaaccaaacaccgcatattatcactcataagtgggggttgaacaatgaggacacatggactcagggaggggaacatcacacaccagggcatgtcggggagtggggggctaggggagggatagcattgggagaaatacctaatgtagatgacgggttgatgtgtgcagcaaaccaccatggcatgtgtatgcctatgtaacaagcctgcacattctgcacctgtatcccagaacttaaagtataagaataaaaaaaggaaaatacttataagaaatgtggtggctcacgcctgtaaccccagcacttcgggaggccgagacaggtggatcacctgaggtcaggagttggagaccagcctggccatcatggtgaaaccccatctctactaaaaatacaaaaattagctgggcgtggtggcaggcacctgtaatcccagctacttgggaggctgaggcaggagaattgcttgaacctgggaggcagaggttgcagtgagccaagatcgtgtcattgcactccagcctgggtgataagagtgaggctgtgtctcactacaaagaaaaagaaaagaaaatattccttcttcattcccttaatgtttagtagtgtcaacaactacaagcatttatgaaaattcatgcgtataaaataagtcttacttcatttttttaaccaatagactatctttatgatgtccaattttttaaagaggcaaatccaatacctgaattatcaatttattctattttctacaatcaaaacaggcaagttaaaaggtatagtctaatcaaaagtgctttttaaaaattaattattttagatttctagaaaactccacctgacactatctgaatgctgacataataatactaccccatgtcccagctatttattgtctttgaattgtcctcaggaaaaaaattcagagaaattatgagcttcagactaaccaaagggaacaattacataaattattcaatattgaaaatgtgtgtaatttaggctattataattatacataaaatgataaaagcaatttcacatttaaaagatcacatttacctttttcctctcagggaaatatatatgcataaaataaagcttaggtagcaattataaattatagataaaaattgaataattacagtcctggtttcttacattgtgattatgatgattattttatttcattaaacatacttaccaaaacctttaactaactgcattttgccccataaagctaacaagaaaagggagtcaagccctgcttcaaaatttttcagtgtaagttctcacccatgaatgacacagactttagagtttgaaatggcatgagtgaagttatacggattaacatgtttaacaaaaagagccagtttttcttctgccttaggctccttctgatccaacacaaaatctatttagttatatgaataattatgttatccacttcatttccccaaaataaatacacttgagtggaaagtgccccatttgtaatgaaatctttgtttccattttaagctcattagtccatttaattcaagaaaattaaatcgaatcaaggaatgaaaatttcaataagcattgccgtttaggttctcatcataatacacaaaaatgaaaactccctaagtttttgcccctagtttaaactgctacccttgttagattaattcttgctgaatccttgtgcatgctttatagtaagcaaggaaataaactttgtttcaagagttcattttatcaaattcaattttctaaactgctgtgttttttttgaggtaaaactagatataggaatcattcaaaataaagagatgtcttaatttttgcattattattatttgaagatcaggttagaatggaactcctttgctgcacctaagtaatgtagttgcaaatgttgtgttatttcacgtaattcaaacagtttaggtatgactcagttaggtgattagttgatattattaattttgacataagtctgatagcatgcagcacactcaggaaataggtttattgaatcatcatttattaattggagctgcgtatctattttgtccacattgagataaaaattcctttctttaatatttttccgatagtaaatataattgctactaattaaaaaacattttggaaaatattttagaaaaataacaaccaaaaattagccataattccaccatccagatttatctacactgtgcttttaaaatttcatcaatagtctttaaacatatataccttaaaatctggtctagagccataaagacagtatacaaggtaatagtatgttaaattttgtaagcttcctattatgcttaacaccatattatgttcccatattcctaagtattcttgcacctgttgcaatgtcaatttaacccacagtgatcagaaaagcatatcagtgaaattcttaactgcagatgactcattgtcactcagagttgttccggaatatgtgtgaagtccaggtgacagagccagttcttcactgttgtcctctggtccatctataggcagtgacagagcagactcatcaacattttgaagcctcctcctctggtctcctttcctcttaccttttctacttcttttctataggtagcatctctgctacacattgctattcctttttctacccatatttgtgattcttcagtgtggagtttctacaacaaaaaaagaggctggccgaggcgggtggatcacgaggtcaggagttcaagaccagcctgaccaagatggtgaaaccccatctctactaaaaatgcaaaagttagctgggcgtggtggcgggtgcctgtagtcccagctacttgggaggctgaggcagggaattgcttgaacccaagagctggagtttgcagtgagccgagattgccccactgccctccagcctgggcaacagagcgagactccatctcaataaacaaaaaaaaaaaaaaagaaaaaaaaaagaaaaagaggctgggcttgatggctcacgcctgtaaacccagcaatttgggaggctgaggtgggagtttgagcccaggagtttgagaccagccttggcaacatggagaaaccacatctctacaaaaatacaaaaatagacccgaggccaggcgcggtggctcatgcctgtaatcccagcactttgggaggctgagatgggcagatcacctgaggtcaggagttcgagatcagcctggccaacatggtgaaaccccgtctctactaaaaacacaaaaattagctgggtgtggtggcacacacctgtaatcccagctacttggggggctgaggcagaagaattgcttgaattcgggaggcggaggttgcagtgagcctagatcgtgccactgcactccagcctgggcaacagagtgagactttatcacaaaaaaatatatatatattaaccaagcatggtggtgtacacatgtagtcccagttactcagaaggctgaggcaggaggatcacctgagcctggaggtccaggctgcagtgagctgtgatttgtgccactgcactctagcctgggtgacagaggacagagggagaccttgtctcaaaaaaaaaaaagaaagaaaaatagattgtgtgtatatataattttatgtaaaattataaatatacatttataaaatatatttatattcttacataaaagaaaatgattttatatatataaaatattatatttatatacacaatattttttcttttagaaatgtagtttttgacttctcagtcctgacatactatattagagaaatacattttctcaaataaaagtgaagatggtgagggtgcaaaaaggtaatgaaagcatagacctttttcataagtgttaaactgtgggttattctgcatagcatgatgcaaacctggactgttcctgctacctcacctggaacatgaatcatttctttgtcgggtgtcttctggctatagatgctaccctcccattagtcacttggtacccatcgtggtgatcaggacatcacagggctggtgttcaaataactcttactttacttaatcatggccccagagtgcaagagtggtgatgctggctatgtggatattccaagagaagccataaattacttcctttaagtgaaaaagtgaaagttcttgtcttaataaggaaagaagaaaaacttttattgcagcatattgttagaattattctatttttattattagttattgtcattaatctcttactgtccttactttgtaaactaaactttctcataggtatgtatgtataggaaaaacgtggtatatataaggttctgtactatctgtggtttcagatatacactgggggtcttggaacgtatgccccacgggtaaggggcatgattgtaatggcaacatattatgccatcatatggacataccaaacgtatttagctaatctattattcaaggatttaagctatttttacagtttccatttataaataacaatgcaatgaaaactgttcttctccaatagattccttaagataaattcctagaggtgaatgattagatcaagaatataagcatttttatggctctaaattcgaaatatcatgtgtctaatagagagctatgattgacactctctggtagttggttattgtctgtttgcctcctcttcaactgacccgaaacctaagatccatctttgcctttttctgttctgctttacctcctaggaagttgattggcgtgagcttgattacaccatatgggcttccttgcccttggtgtctggttgggttcgattaaagaaaggcactggcaggagatggaaaggtgggaatagaagatcaggggatttatccatactcatcacaccttctctatttttcttcctggaaataactgtggtgtacatttagagttcttataggaaatcccaatttctacagtgcagactttaaccagtctcctgtaatccaattttctccctttctgggctgaagtttggtaatggttttctgctgcttctacttctttggtgcctcgcttataatttgtaattcccttaactgtgttcacaccccaataaatagaacctattgactccgcatacactgactttctaaagtaagtccagaaaagttttcctgattcctgggactgctggcctcctccctgaaagccctgacttgcctgtagcactgtgattgatacttaagactcagcgtcatgagcaatgccccacatctgccatgtacctgtgcccgcatgactgcccagccaccccgaaatcaagatgacttctctcttgtgcctcttttcaactcttgcatagtgcctctcagtagaagactacagctggaaccctgctgtgaaaaacaactaggaaatgcaagaagagcttagaagggtaagcctgcttctgaaaacagcaagctgtatctggtaccgttcaccacttggataataacttttatatacatcttccactcatatttaaactttcaaactcatcagtggcaacatcatgttttgcctaacatggtgccaagaagatgtgctcattacaaaccccaaaataggaggtcaaacttcctataagcctctgtactttcttgtgatgtgtattcatttactagtacagccaccgtcatgttttgatcttatacaacttaatgaccaccaccaccaatttacagtagaaaattttagtagatgggaatgagcttctgcaaaggattctgcaacttgtcatgaggttgtatgtggaacttataattttttcattccatattaatttcttgtttctttgccctcagcttgagttttatgaagtcatagctcctgaccttgtagattgagtcaaattatcattgaaattctgagtcatgccaggcgcggtggcttacccctgtaatcccaacactttgggaggctgaggcgggcagatcacctaaggttgggagatggagaccagcctgactaacatggagaaacgccatctctactaaaaatacaaaattagctgggtgtggtggcacatgcctgtaatcccagctattgggaggctgaggagggaagatcgcttgaacccaggagttggaggttgcggtgagatcgcgccattgcactccagcctgggcaacaagagcaaaactccgtctcaaaaacaaaacaaacaaacaaaacaacaacaacaacaaaaaagaaattctgagtcattagtgatcttactacttgggagtgttttagtgtttcattatcttatgtcattggacaggggcattactaagaagtacaatcaggatttcacttgaattccagaaattattcttgtggtttccattttgtaggaacagctgcatttttcccttgataagcaggaatgatcaaatgtgattcacctttgttgctaattgatgacctgtacatgataatgtggcagcctcaacttggaattcaggacagccattgtgctcacaggtggaaacatattatctttttaaaatcaaagtcctataaattattattgtgcaagacttggaggagaggaagtgtaataaagaattggacaccatattttgatatttgattttgatatttgactgcctcacatgccttgctcccatgaatacctctctgcctcccgtctgggcacactgataagaaagcctggctgctctctcctttggtgcaggccagaggttcaaatgatacaaattcctgcctgtgtacagcagccctcaccatgctcctaccccagacacaataataacccttaggccatgagggatccaccttcatggatgggattaatgccttataaaacggctgaaggaaactagctaggccgactagttcaattttttacttgctcactcaagccagttttgggcctgttgaggagacctgccctgctccctccagaaaataaaagtaataaagcttttcataccctcttaataggtatgtggtgttatcagtcttgacatctgatccaaatgatcagtggaggaccatcctgtatagaggtgctacaataagtggtaaaaatgttgattttgatcattaggattaatagtaagaagagccattgtattttcatcctttggctccaaatgcattttggcaatgggaaaagcaactcctcatgttggtaaattgctatctttcaagatataaggatatattaaagaatagcattccagatataaaacgagttatcaccagccagcttcataattgatctctaatggatcattttaccattgtataaataacatatttgtgtcttccttttgaaaacttacaactatttttaaaaatttgctgaactagctgaggcccctagcagaatgatgaatagaagtaacaatgtgaggcaactttacttcatttctgaactcaagggggaaaaagagcaatgttcactattaagatagatgctaacattttttcttcagattttcattatcaaatgtatctgttatttgtctttgtatcaaaccaaatcatgagttagtagcttcaatcattatcatgtatttagatgctaggtctctgggtaagaagtttaggctaggctaagttgggtaattctttgatggtcttgatagatgatgtctgttcaactaagccttataattgttgtgaagtgatctactttatttctggtacttcattttgctttaaagtctacttcttattttaacatagctaccttaatgttcttcgatgggtgtttatatagtatgtctttttctatacctttacattttctgcatgcaaataattcagatgtattttttatgggcatgtatatatacattttgcttgtattttttcatttagactgacaaacactttttttcacatgggaaattgtgaatttatttatacattgagttttaattctgtgatatgattatgttattcttatttggccctaatattttacttctgatttcctttctttttgactgattaatatatttaatatttttattattctatttttcttattggtattttagttatacagtctttcactattctatgaattgttaacctagacatttgatgctctcttgacttatgtaattctttcatttaatattttcaaacacaacagtgtataaatttttgttttattcaaaaatgttacttttttttttttttggtctcactctgtcaccatggctggaatgcagtggtgacatctcagctcactgcaacctctgcctcccgggttcaagcggttctcctgcctcagcctcctgagtagctggtattacaggcacctcccaccatgcttggctaagttttgtatttctagtagagatggggtttctccatgttggtcaggctggtctccaactcctgacctcaaattatctgtccttcctcggcctcccaaagtgctgggattacaggtgtgagcaattgcgcctgaaatattactttgtatttacccacatatttcacattttcattgctttttgcaattaagtatatatgaaatcttctaactgtgaccttgctatctcttatcccctcttttgtagtttttattgttttgtctttctgagctttagtcttgatagtttcttctcatctgtctgcaagtttactacattcttcatttatatctcatttcctcttatatttgcacactaaattattaattttggtaaacatattttgtgtaaaatgtttacactaaacttttttttaaaaaagagttttaaaaagtatgataccagttttttttttttttttttttttttgagatggagtcttaatctgttgcccaggctggagtgcaatggcacgatctcggctcactgcaacctccgcctccctgattcaagcgattctcctgcctcagcttcccgagaagctgggattacaggcacctgacactgcgcctggctaattttgtatttttagtagagacagggtttcaccatgctggccaggctggtcttgaactccggacctcaggcgatctgcccgccttggcctcccaaagtgctgggattacaggcctgagccaccatgccaggctgataccagtttttaaaatcttttagttctttcttgaaatgctgcttaaacttgcgtttatagtaactgtagatattttataacccatacatattattaattctactctttggagtacctgaggacctaattttatttaatattttgtgtatgttggtccctactcatctgccatatcttctaatttccctagatatctttgtgtagtggacattttagttgaagcactatttttagaaataaatttcaagatattggataatctaatatcctcccagagagaactttttaacctcttcaggacctgagaacataagaaatatatgaccagcctaatccaatttcagaaagttagattgtttaggactgctggtgtaactcaaagagatgttatagtcctatgtaagggcttgcttacttctatgtatgtttactcttaggacacagcactttaaaacttcaactctaaataagaatggtttacagtgcctcaaagttagcatgttctattgtattcttattcctcttcttcttgttccacaagggtacaaatttcctgctaattctatcagcatagtggccctaaatgcttggtttctttcactgatatacaatgtatatcagtgtatcttagccttgtaacttcttgttatttgattattctaggaaattattttagttactgcagttataattttattttgttttaagtaaagattgctatttcctaagttcactattactaaaatcagaagtctcccacttcactgttttatttaggcattttcttccccactctgtgtcttagtccatttgtgcagctataacaaaatgccttagactgggtaatttataatcagcatacatttattgatcacagttaaggaggctggatatttaaagatcaaggtaccggcgggatcattgtctggtcaggacccaatctcatttatgaggcattaatcctattcatgacagtggattcttcatgagctgatcacctcttaaatgtttcaccccttaatacggtgtgctttgggtataagtttcagtataaattttgaagagcacacaaacattcaaactgtaccaccctgataggaaaagctgatagaaccataaatctcatgaactagagatgatttacacaatattttattgtaaaataaaattccctgatcaaaggcaatgctgagtgaaacgttatgatgatgaataagatatttaataaatatatggatggtagtgttggcggaattaatacagatagagaatgcagctgcaaattaggtgtaagtgtctattttactgcggacaaatggctgctcctgccatgatggaagaattccaatgtaatcaatcctaatttgctaccagttggctgttcttcctctccagggaatggtgccatatcaaggaatcaacactattctgttgttgacatattagatatgcagtagtaacgttagccaaatcagtcttgggaagacaagattatgcaatcattttatccttgctggcatggctatattttttatgtactcatttagcaagaaccaggtcatttggggaagaaggcagactgacctctattgaatagatcattttatctacctgatcactaagagcttgatttatagaagatacgctctgatgatcgatcttatggcagttaaagcttcgtatgctcagttcttatactgagtatcagtccagagatctcatactcattcctcaaatgttattccttcagagcctatgataatcagcgaagccattagccactgttcatgtttcagtatggctccaaaacttggttatctcttcttagagccgaagtagacaaacagatgtgttgttccacattctatccatgggaagtaattttttatccactgttattcaaggacatacctgtgaaggactttgggagcaaccagtgttgccttaggccgtatcaacctattatatggaactatcctaaatgaagctccagatttttttatttctcatttaactggtcataaagaattccacatgaagccatagatttgggtggaggtagaggtggtaatagtaggtccttgggagcctgagccattgattataagatttttgccttcagaaagagctttgtcctgatcttttctataacactcacacttggcaatagaatacttaactctaggccttcatagatcatacatattttctgatacatatatatatttttttttgagatggagtgtcgctctgttgcccaggctggagtgcagtggtgtggtcttgtctcactgcagcctccacctcccaggttcatgccattctcctgcctcagcctcccaagtagctgggcctacaggcgcccgccaccacgcccggctaattttttgtatttttagtagagacagggtttcaccatgttagccacgatggtcttgatctcctgacctcgtgatccgcctgcctcggcctcccaaagtgctgggattacaggcgtgagccaccgtgcctggtcagatacgtgtgttctagtatacatattttctgataggcaggtcagatcacaagatccatttgtcactcatggtcaggtattctgtctctactagtgcccagcattaagccagaagttgttgtcaaaaggagaatatcttttggaagaagagtgcatgcttatcagagcttgtcagaagctccatgtacaccaaccatatctgccacagacacttgcagttctattgacctggctcatacagctcaagtggcttagtagcttgcagtgtcctggacttactcttgttcttgaacccacaaaaattgacagccttatagtttatttggtaaatgggtccaataggtatactataccaataagttatatataattttcccattgtagagagttgtacttctttcttagaagaaaatcccaacaactttatcatttttcctttggaaaaacaatctaacataccttagaaaactagactcatagaatcttttctaagttaatgaccatgattttcacttaatttttactttctgataagaggtaagcatttcttaccaataggataaaatagttattacttcctgatcaatcagtccaatcagcaagtgaccaatatggcaaaatggtatgatgcttaaactgatatcaagataagcaaggtccattaaagactagactatgacaataacggagatgacataatcctgaggtaagactgagaagttatgcttatgtctctaccaagtaaaagaaaactacatctagtggtctctactgaggacaaattgctgctcctgccatgatggaagaattccaatataatcaatcttaatttgctaccagttggctgttcttcctctccagggaatcgtgccatatcaaggaatcaacactattctgttattgacatattagatatgcaatcgtaatgttggcaaatcagtcttggtaagacaagactatgcaatcattttatccctgctaacatggctatattttttatgtactcatttagtgagagccagttcatttgggaaagagggcagactgacctctactgactagatcattttatctacctggtcactaagagcttgatctatagaagatacacttgatctataggagatctaagaagatacatctcttttttcattgatagagataacaaagcattttttgaatagatagctttatgtcagatggcagaggctgtgttaatttgcttacaaagataagacatcagtgcaattagggttctcatgtggttatataatgaatttgtattgtcatttttaaagataggtttgccttatacaaaggttaatgagaaagttaagtagaaatataattcattgttgctttaaactttgaaattccctgagaaatatggttttgaatttagttgtctattttgacagaggaagttcaattggttctatctttttctttaacacattgatcgtagttattttacatatcctatctgaaagggtctatatcttggccattgcttactgattaatttctctcttgtcaatactcctactcctaccccacccaactctatttttttttttttttgagacatagtcttactctgttgcccaggctggagtacagtggcacgatctcagcttcctgcaaccctttcctcctgggttcaagtgattctcctgtctcagcctcctgagtagctgggactataggcacgcacccccaagcccagctaatttttgtatttttagtagagatgggattttgccatgttgtccaggctggtccacccaactctattttatggctcatcatttttgattaaatgacagacactaagtgtaaaaaacaaacaaacagaaaacatacagttcaaacctgtgttgttcaagggtcagctgtgctccatttcctcctgggttcaagggattttcccacttcagcctcccgagcagctgggattacaggtgcccgccaccacacccagctaattattttttgtagttttagtagagacggtgcttcaccatgttggccaggctggtctcaacctcctaaccttatgatccgccctcctctgcttcccaaagtgctgggattaccggtgtgaggcactgtgcctggtcatccccagatttttaatggaaaatgatgctgtactgagatgaagagcttgtagtgagtatgaaatcctcatgtctttgtgtgtgtaggactcccaattatattccaaactgatattctaatcatactcagtctttacaattttagctgagttctttctacccgcttctatgacagccactccttcctctcatgctttggtaaagggaaaaccatttggttttcttcctcctcctagggatttgtcactcttgcatttaggtgtcttggttaccttatgaccttcagctctttgatgagttatagaaaagttaggttgtatagattgtctattttttttttcctagatgttaggatggttgtgactttggtactttctactaccagtaagatttttgacgcaggaaattcgaggcaaacaaaatcattggaaagtttgagaagtaaaaaaatatggaagctcagagattatcaggaagccacctccagcggttttatctgtgatcacactgaagtagatggttctcagcagggcatccaaatctataggcttctgccttcagcaaattgctgacaactaagcatctacttgctgttgccacttgagaataatctcttccaactttccaaaccaatagataaatttcttgtagaaatctttccataaccttcctggcaagaaaaacttgcaagtaaagtgttcaagattaatgcctctgcataccgcaaagagtttgcaatggtataaaatagactgagtatcaacaaataacatcaggcacatctcaacccattcaattttaatttccagtataagcaaatgattaaatctctaaatatgtgtttatataactgatcttttaaataaatgttacatgttttataatccctaagttatatttagaatatgctgtaatgactctgcaaatatcacaggataaaccattttaatttattttaaaagcaccaaacaaaatttctaaaggaaactcatgctaagcaattgttaaaattaatctctgcttgatagaagtcatattagtatatagattctataccttatgaactttgggggcttatgctttttaaataaaataattacatagattataaaatgcttcattttggacatagtaattaatgtgctagtttatgtgggtaaaatattatcattttatatagattttatagcaaggttttctcagagtcaatgctatcaagtccagtatgcacttcttaacaatgtattctaagttcttcagaatacacctatggataaaatactactcagcaatacaaatgaattaactactgatgcatacaacaacattgatctcagaaagcaatatacttagtgaaagaagccaggcatagaagagttctactgtatgagtctattcacattaaactcgggaaaggactaatttagtgagacagaaaacagatcagtggttgcctaggactgggggtatgaagggggctgactgggaagttacaagaaggaaattttgaggcaaaggagatatcctatatcttgattttgatggtatataaatttatcacaactcactgaaatgaacacttcagtgggtgcactttatttacataactcatatttcaataaagtataatcagtccaccctatcggtgggttctgcactcatagagtcaaccaattgcagaccaaaaataccgtagttccccctcatctgcaggggaaatgtttcaggacccccagtggaagcctgaaactgtggatagtactgtggctttaaatactgtttttttcctatatagtaagtggcaggtagcacatgtaatatggttgcgccagacaaagggatgattcatgtcccgggcaggacagaactggatagcatgtttcaccaagatactcagactggcatgcactttaaaacttataaattgtataattctgacattttccacttaatattttcagatcactattgatggttaaattaaaaccacacaagcatgattaaaaccttggacaaactgggagtcgtgtattaggggaaaaaaactaataaaaataacaatacaacaataaaaaaaagtatgggccgggtgcagtggctcatacctgtaatcccagcactctgggaggccgaggcgggcaaatcacaaggtcagaagttcgagaccagcctggccaacatggtgaaatcccgtctctactaaaaatacaaaaaattagctgggcatagtggcgggtgcctgtaatcccaactactcaggaggctgagacagaacccaggaggcggaggttgcagtgggctgagatcctgccactgaactccagcccaggcaacagagtgagactctgtctcaaaaacgaaaaaaaagaagtatgaataaaaattacagtataacaatgatttacatggtatttacattgtattaggtctcataagtgatctacagatgaattaaagtacataggaggatttgtgtaggttacatgcaaatactgtgccattccataaaagggacttgtggagccatagatttggtatttcctgggttctggaaccattccctcttgagagacaaactacttattaaaacaaagaaacaagcaaacaaccaacagaaaaaaactgtcagattggcatgaggtggcaaaattcagtttaatgggggaggatggacttagatataacaaaaactataactatacatgattcgaggcaagatgacacagttttcaggaaagccttctgttagagaatattcctaacaatcaataagatgtttatctgaatggtggttatcctcacatcttctggaagaaacaaatatatatatatacacatatattcttttttttttactgagactttttttttcaagatggagtcttgctgtgttgcccaggctggagtgcagtggcacgatctcggctcactgcaaccactatctcctgggttcaagtgagtctcctgcctcagtttcccgagtatctgggattacaggcacatgctaccacacccagctaatttttgtattttaagtagagacagggtttcactatattggtcagtctggtctcaaactcctgacttcgtgatccgcccgcctcggcctctcaaagtgctgggattacaggtgtgagccacggtgctcggcctcactgagacttttaagagggaagagacactggagtccacatcttttcctcttataaatgatggcatttcacaacctgagcagcaactgagtagggctggagcacaggttttttgagtcctgctgttggcgcttcttagaccactcctccagcattccccaccactgggagttaacgtataacgtgtagcagaaataacaacaggctttggtgccctatagacaaggataagaatcccagccttgccacatagtagctttgtgaacttggctggattacttgcattctatttggttcagtttatttgttggtaaatgagaaaaatccacgtgagcattaaatggggctgcatatatgaagctcctaatgcaatggctggcatataagaaatgtcaaataaacactcagtatattaagctgtagtaatagaggccaggtttcttatttccattctacttaattaacgttctctgatatcactcatgttttgtgagaaaacttacaaatcaaacaagctccatcactcctcccatcttaaatggtgatatgagttaccaagaggactttttgccacctatttgcatgatccttaaattagttgtttaaattcatctaaataagttcacttagttaaactaaaaagtttaaaaatgttcattttgttaacttagttcatccaatcgagtaattagatcataattttaaatccaaattgtacatgggactaatttaaaacttttacaaaggaaaactgcaacccattgagcacaaaatacattacaaaatgttaaaaccgaaaggacacttagaaatcagatattgaaaatgtattgaatttgtagctgatgaaattgttgttcaagtagcttaaagatgtgtctaaagcaattgaaatcattaacaatggccctggaaccataacgtgtagctcaaacatggccttcaaagtcaggcaagttgtaattcaaattccatctccatcattaactgtatctgtgtgaacatggagaaactgcttcacattttttaactttagttttcttatcaatgaaatagaggataacaataattaccagataagattgtcatgaaaaaatgaaaaaaaatatatatatgtataatgtctacataatggctggtgtatagtaggtactcaaataatgttaaggcactttgatacctagtgcttttcagaccatgccaccatgacataaatagaaaccattggcttcccagaatcccctgtgctcgctcagatagtcattttatactatgattttcatgaccatattgattggatcaggagtacatataagagccactcatatttgcatccttcagaatttgaaccacaagaatgaacagaaaaaccaggcagaaaaatcacacatgaagtgtgagttcatgggaattgtgccaggcttaacaacaacacttcaaagatccccacatcctaatctatgccacctgtgagtatacctccttccatagcaaaaagaacttttcatatataattaaattaagtgtcttgagatggggagagcaatttgtatttttcagatggcccaaaggtgtttctaaatgagaggcaggcggctcagagtggtagcaggagacgtagtaatgaacccaagaggttggagtgatgtgaaagggggtcatgagccaagaagcattggtggcctgtagaagctgaaaagggcaaggaaaggaattcttccctagagcctccagaaggaatgcagtcctgctgacaccttgattttagactttgacctccagaactggaagataactaatttgtactgttttaagccactgtgttataatttgttgtagcaaaaatatgaaactaatgcaagaatgttagataacttgaatgaaggtccccagatcctttctgcaggaggtacctggtgtcacgttgaatctaagatcacatttctgatccaatttccttgagggccctcattataatggccctctattcttaagtttccttgaggtcacgacctttccaccaccccacccaatagtttgagagaggtaggaggtctctctcctctcctatcagacaactggtaaataacacccatattgcctttagccattcattcattaaatatgtgatgttgattacaagggtctagctgagctagccaaagaatgacctagggcaagcttattattggtaatgcaataaacataaagttctgtatcttaaattgcagctagaaatagaaagggaatataaatacatgtatatttccagcctcagaagcacacttaaatatataggccacttagaaaggaaagggtaaaataatttgtttagaaaagtgatatttaaaatgaacacattctaaatcattcttggaggcgaaaattatttgcaacaacaactaccttctaggaagaactgttcaatggattgtagtatgtatttttggctgccttgcaagtatctgagtgagctgaatgttttcttcagactgatgattttgagatgtggagcactgcaggttgaatactttagtgataatgaaacatgcaattcaaatacacccttgtgatggctataattacaaagaaatggtttacagagaaggctatatttgaaaagtagatttcgagattttcttgtaactttaaatgttaagatgaatagaagacagaatcacgttcttcggttttcaagtgatggtagatgacaatacttgaatggatagtcttgcctcacttaacgaaagggatacattctgagaaatgtgtcaggtgatttcatcgttatgtaaacaccatggagtgtgcttatccaaacctagatggtacagtctactaggcatctaggtcatggggtttaccctactgttcctaggctataaacttgtcaagcatgttactgtactgaatactataggcaactgaaacacaatggtaagtatttttctatctaaatacagaaaatgtacggaaaaatatgctattataatcttgtaggactactgtcctcttatatgtggttgttgatggaattgttaggtggcacatgactgtacttgtttccaggcactctgaacttgctaactttgtcccgaagatgcactggcattaaagagcaatggaaaaatatgaggagttaaaatctcgtagaagcaggtacaattgtatgaaaaggtcattttcttgatggattacatcacaaggattttaaatacttattcagcatcgccatcgagcacagttcctcagccttggctgcagactgaggggaatcacctgaggtgctttcaaaatgtagggacacctgacttctaccaccagaagctgatttaactggtttcaggtgtggcctgcgtatgttttaaagcttcttgcacccagataatggtaacattcagcctggcctggcctgcccacctgcttgcttttggatccatcctcactctatggctacggatctcttaactgaaactaacttttggctgtctaagccttagcaggtctgattgtcaacatggcattacttccgctatgaaagacaagcaatgacccagctaaagcccaacacactgggaatagctgtcacagtgatctcaaattaaatattatcaaaacatccaggacccctgccaccaatttttctctcctcataacaagatattttaataactctgatccatatgtgggtgggtgggtagcagtagctacttggatagcatcttggcattacaaaggcagtcatttatcctaagaaatcttaattcagctattgtctcttatttaccttggtcttgaacttgtactaaaatctagagacatgctgttgaaagaagtaacctaactcaatcagctgacaaggaaaggaatatattctgcagacctatggacattaaaagttactctgctttaatggaaagtgtttttttctctgattttatttattttttatttttattatttttttgagacggagtctcgctctgtcaccaaggctggagtgcagtggcacgatcttggctcactgcaacctctgcctccagggttcaagcgattctcctgcctcagcctcccaagtagctgagattacaggtgcccgctaccatgcccagctaattcctacatttttagtagagatggagttttgctatgttggtcaggctggtctcgaactgctgacctcaggtgatctgcccacctcagcctcccaaagtgctgggattacagatgtgagtcaccgcaccttgcctttctctgattttataaccttatttcttataatattaatttagtaatctaacataaatacactttttaaatgacagggattactgttaccactttcatctgttctctagtctgtggcttgccctttactaacctcaaagttgagtgtcatatagggatctgggttggaggattttgtttcttatcgtggagagactcattttctagaggatgaataaagggtatatgtgatgccttacagagtttggaagcaaaagatcagttgtagtaaaattgttcgagctgtttcttttgtgtgtgtgtgtgtttttttgtttgtgtgtttgtttgtttgtttttttggtttttttttgagacggagtctcagtctgtcacccaggctggaatgcagtagcctgatctctgctcactgcaagctttgccttctgggttcataccgttttcctgcctcaatctcccgagtagctgggactacaggcgcccaccaccatgcccggctaattttttgtatttttagtaaagacgaggtttcactgtgttatccaggatggtctcgatctcctgacctcgtgatctgcccgtctcagcctcccaaagtgccgggattacaggcgtgagccaccgcgcccggctgttcgggctgttttttacctggcaagatgttctggcattgtcagaaccaggacaagctggctgtgtgttttgcagtctcttctcttattccaactatgtaaatatataacgttagaacacaaacatacacacaagctgtggtcaaagagaaagatttctcaaaggagctgcatctgtgaggaattctcgagagagtgtaagtaggtgagggtttactgaagaataacatggcagcatgagatcctgcaggagagaaaatcacagaagatggtggtcatattaaaggagatatatgcctggaagtggtggatcctagaagcaggggaggcctcggagcacctgccagggagattagtttaggcattgcagtggacccagtcaaactgctggctccctgcacactccctgcgtcactgtgagccacggcactggagacatgacatccaataaaagtgggagcagtcctgagcacagggaggctgataagccttcataacctcatagcagatagtcttaagctatctcaatgagactagtttttaggagcaaataatcaaagtggatatagcagacaatttgtgtagaagcatgtaattgctgaaaatcaagaactagaagcaataagaactccccaccccaaaaagtgagaaaagaatctgaattggcaattcactgagagaaaataaaaatggccaattcatatgaagcaattctcagcataaccacacatttagaaactgaaatttacaaagaaatttttttttggcaaaagtaaatgtctgataatgtcagtggtggcgaggataaggctaaggtgtcatatattaccaacagggagaaaatagttgtggacactaaataaaaatgagcaaaatctagtgaaattaaaaatatacaatctatgattcagctactttaattccacatgtaaaattttgaaaatattaattacggtaaataaaatggcattacaaagatgtttattgcaccagtaccataacagcagataagtgaagaaatgttatatatctatgaaaagcaccagagtaatgtcacacaaccataaaatgaaaattatcatcagttaaaagaatgaattatacctacggtcatcaatatgaatacagcaaaatataaatttttgagtgaaaaagcaaggtaaaattgaatactttgagcattacactatttatgtgaatattatggcacaagacattaacaaaattatatacacacatattagttgcctacattcctcttaaacgttgtcagtctacttcctttcataacaaaagttgtcagaagaattgcctgtacttgttttctttttcctattttcttctttaactcactcgtgcaaggctttgttcccacctctccactgaaaccacaaaaccaatgttgtctgtgacccctaccttgtcaaatacacggattgtgtcatagtccttgactttagtgactcactgcctctttcttgaactcatttcactgcttgctttccaacataccacacttttgttttcccaaacttcaatttgtttctagtttgaataaattaaaattgagtttaagaaaaggaagttagaacttacttcctgtaagtctatttatctttttctatcattttacatactacgtagaagctgatggcactaaatatcttcagaacaaacttctccccctgaaatccaggcttagttaattaagtcacttttcactatatctgcttccactacctccttggaaggtattataatttttcacctgaatactgcaggtctaaaaatacgtcctcataggctctacttttatacaatgacagtctattctttataaatcagactggatacacttacagaattcctgatataagcttcatatttttgagtgaaatgtgggttgtaagtcttagcattgactgatcaagggagaattagccctaaattaatgaattataataactaaatttttataccttctttttcacttgtgacatgatacctgaattattcagagtgcctacaaatcttgggtactcatttcgaggaaagacatgaccttatattccacttgccagagaggggttaaatcatcatcttgaggttacagcaatctatagattctatacatattttagtggcagatttcagtgcttgctttatatatattttagcagcagttttcagtgagtggcagatttcagcaagtgccaaaatctcactgggacaaacccttcagaaaatagaagagaatactgctgtctgggactaggtgaatacagatctgtttttaattttcaggcttccttgtgaaaatttaatgtttaaaacatctaagccaggttaaaagttctaatagttctgactgctggtagaacggacataattcttcattgcgaggtgtccttgacagaacgcctcttgttattatagagatacaggccttatgaagattctttccttcatggttacctctcttcctctgttttcatttgtttgtttgaccaagtcctacgctgtgcatactccagaatcacacacacactgtgtcacttatcaatcctgccgtccctgatttcagttgatgatttttgtctattactaatgtagattatctgattctaccatcactctattagctgctaatggcctaattcaattgttatctataatctgttatttttcttaagaaattaggtctatgattgaatttttcataatttttctctgcagcaaacttcgtttggaacatctgggagtgataactcaaaagtagcaatattcttgatatggacagggtagtatagtgaaagtggcggtgattatcctcatttaaaaagtgagtctattttacattttaattgtggtgatgaacatatttcaaggagatactagcttatacttaggagaatgctctcagtgccaacagacaatgagggatcaatttatcattaactgattagacgagacttattttggcaattggaaagagaaggcaaatatatccagaatgttcagagaatttcgttttttattccactttccatagtcacttgtatccagagcttatattttatttttgagttgaataaaataacattcataatgttatggcatgatgtgttttggtacattcagcaagtgccacaatctcactgggacaaatccccataccattcataatcgccaatagttacaataatcactgtttagctttgtattatgtactataacttttaccaggcaataatagtcacttgaaataaccatattcaacttaaaggaaatttaagagttaaaaatatctatgtgattatcaaagaaaatgtaaaaagctgaacatagaactgtttctagtaatatggtagataagctacctagaagcttggcttatacaccacaaaacatttaggagacttgtataagaaaactcccagtatttttttttttttttaaaggaagctagaaaccagagctttcagctgaggctgtgaatgctgtaagctacacggatgtgctttggtcaaggaatgggccgaggcagacatcccggcctgcatgactcagcgggactggtgcacaggcacacacctctacttgttatataacctgtttctgtaagctcatacttggctctatgcccctattgtttgtaaaaggtataactgccctgctgatgctgtgcaggggctcttgggcgtggcttggctcggcttggcataacatggctcaacatggcgctggtgcccagagaacgagagagcgagccaaagctgtccgtcttgaaggcgggcagggggaagccaggaaccaggaaagagttaagcttctgacccggaagaaaagggagagctggccgcgcagctgtgcgtggaaatggccggctcaagcagccgagacagagcagagtgtgagagagctaatggaagtaagctgctgaagaaaccgtattcacctgcctatggcccgtgagtgttcttgaagctatctggcgttcatccacccactcccctcggacctcagcatgggctggaacctcaccctagacctaacagatgctctcatgagcactcttcaaactcagaaatttcccttacgtcatcacgagccgaagatttctaattaaagtatgtcaagatgaagtggacttaattgacatctgccttttaaagtataattcgttcttttcttgaaactcggatctctaagtagtagaatatttagtaaatataactcccatccttattctaggcgatttgggaaataaaatattagatgtgaagcttaatacaacgtttgaaaatattataaacactttgttttagtctattattttggttgttaatgtcagaaactcagatcaagttggataaatttaggagactcaaatattttcataagggtgcgttttctctccatttctagtatttcctctgtagtttaggtttattttctccctctgtagatggactccctctataaagtcaaggaatattacggccacgagtggtggctcacgcctgtaatcccggcactttgggaggccgaggcaggcggatcacgaggtcaggagatcaagaccatcctggccaacatggtgaaatcctgtctctactaaaaatacataaattagctgggtgtggttgtgagtgcctgtaatcccagctactcgggaggctgaggcaggagaatagcttgaactagggaggtggaggctgcagtgagctgagatggcaccactgcactccagcctggtgacagagcaagactccatctaaaaaaaaaaaaaaaaaagtcaaggaatattactagcggctcagatttggttgcatagtttatctgccacagtgggaaaggggtgtgaagccttcttacccaaaaattctgataagagtgactagagttaatacaacgtgattctgatgattggcccttggttctgagccaggttgtcaacccaaaacaacaacaaaaagctaagagaatatgctaatcccattgccaagtctagcaccatgcttgatgccagagagttgcgtcagttccagccaaattacacagataattaggagagaagagataaattgtcaaagaaaacaggtgtgcagttactagcaggagagcaaatgagtgagtttactcttcctctggtactcccagaaccaaaaatgtccaaaacctaaacttcatatgtcatctcattttatttgctatttggtgagtagctttaccaagttgtcattctttgagagctctaggatcaacggattcttctccctgcctttgagcttttaacagattctttaacgtccgctgaactgttaatacactgcaaatggcattggataaagggaatgggttgtagcttgcttctgccagtagttactatcagttataattgtagacaataaatccaatttctttaaactccaaatttcttgtttgaaaaaattctatgcaagattcaatcaattttttagactctagatcctcttggatccaaacaagttccctcggttctttcaaagtcactgaatttgattgccatatatttatagagttcatggcttgtaaatataacttttggaaaatactcaaaattttagattattataattgcagatcctttttcaccccactaacatctcctttctcccgattgtatgcattgtcatcgaaccttcgtggtcacttaataagtttaaacaattttggatatttccaaaagcccgttttgttttaccttcaatttgaaaatcaaacaaaatactaacttagactcaaacatgtaatccctttcaaaggtgtagatttgtttttctgttttttagctcctaatgaaactgataaaatatttattttatctaatataactagagagaatattggtcattggtatttgcatcccttcctactgttcatcttcagtatgttacaaattttaacaaatatcttaaacaatggcctatgagtttatgtattttcattagttataaaatataactgacataaaataagctgcatgtacttaaggcatataaagtgataagatttgatacgtgtatacacccataaaaccatcaccataatcaagagtgagtacatccataatccccaaagatttcccgtgcccctttcttatatcttttcttcccccacccatgtccagggctaccactgatctgcttctttctctatagattagttgtgttttctcaacatttgcataaatcaagccacgaagtatggcttctttcagttagcataattattttgcaattcatacatgctcttgtgtttcaatagttcaatatttctcactattaagcagtcttccatgataggtatatactaaaatttgttaatccatttaatgatgggcagttgtgttgtttcctgtttctgattattacatataaatctgctatggccatgtgtataccaatttgtatatggatgcatgctttttttcctcttgggtaaatacctaggagtagaatgtctccatcatatgataggtagatgtttaaatttaagaagcttacgttgtcttacaaaatggttgtagttgtttacattgctgccaccaatctttcagtttcagttgttctgtgttcttgacagcacttggtattgtcagtcttttaaaattagacaatctaatagatgtttattgatatagcattgtggatttaatttgcattagcctaatgattaatatgttaagcatcttttctatgtatttatttgccatttgtatgttttcttgggtgaaatatctgttcaaatagtctgtcgacttttatattgagttgttttttaaaaaattattggtctgagcatgctttatatttttttagatacaagtcctttgttaatgatttgcctcaattttctgctaggctgtggtttgccttttttacctgtttagcagtgtattctgaggatcaaaaaaatttaaaaattgaatgtagctaagttaaccatatattccttatttgattatgttttagactcatatttttaacaaacctctgtaaaccaattttcacaaatatttcccacatttcttgagcaacttttcgtatattttacatgatatagaacaaagttcatttttttctccatatggacttaccattttcctagtgctgttcattgaacacaatcctcctaccactgaattgctttgacaaaaattgtatttgtgggtcaatttctgggccccctattctgttttattgatgtacttttctatgttgatgccaattaaatcagtcttgattactgatgtggtttggctgtgtcctcacccaaactctcatcttgaattgtaatcaccgtaatccccatgagccccacctgtcaaggcagagaccaggtggaggtaattgaatcatgggggtggttttctcaatgctgtcctcttgatggtgagtgagttctcacgagatctgatggttttgtgtttgttagttcctcccgagttcattctgcttcctgccacactgtgaaaaaggtgcctttcttctggtttgccttctaccatgactgcaagtttcctgaggcctccccagccatgcagaactgtgagtcaattaaacctctttcctttataaattacccagtttcgggcagttctttataacagtgtaaaaattgactaatacaattactgtaactttttaagtgttgcaatcaatatcctataattttgttctcttttaaaattattttgactattctagttcctttggttttcatatgaattatagaatcaccttgtcaatttctacaaaaattctgttgagatttttatttttattgaaattgtgttgaatctttaggtcccctctggggaaatttacatcttaagaaaattgagtcatcagaattataaaaatggcacatctctccctttaagtattctttaatttctctcagcaatgttttatttttagtgcatgtcttgtatatcttttgtcagatttatttgtaagaatctcatttttgatgcaatctaaatgtttcttaaattgtcagttgtgtccactgctagtatgtggagatatttgatttgtttttatctttccaccttactaaattagttattaattttgatagctttttgtagattgcatcaggttttctacaaagtcacaagtgtcatctgtgaatgaagagagttttatttcttccttttctatgtgtatgtctttttattttttgatgactttttgcactggctaaaatgtccagttcaatgttaaatagaagcagcgagagaagacatttctatctgcttgctcgttttaggatgaaagcacgctgtctctcaccattaattacgatggtagatgttggtttattgtagatgtcctttataatatcgaataatttcccttttattcttactttgttgaaagtttttatcaggactaaatgttggattttttcaaatgttttttctgagtttaaggttatcatatagtttttcttttcagtttgttaatatggtgaataatactgatttctcttcaaacgtaaaatcaaacatcatatatattttcagattcttatatattaaaattttgtttgaaactttacatttatgttcattgggagtacttgtttgtagtttttctggaaatgtctgcttttggcatcagagtaattctggccttacggaacgtgctgggaagcattctgtcctcttccatttatgtttggcagagttcaatgaagtatttaatatgagcatataattttccttgtgggaaagctttaaattccctttttaaaattaatatgagacttttatcaattatttttgtttttgaagtaatttgtcattcacattatattggagttgttgaatattttggcatacatttttcatatgattaccttaaaattctgttaatacatagaatatgaactactgttattttttattcttggtatagttaattcggatcttattcctccctaccttttcttcctggcaaatctgactcaagttttatcagattttttttcctctctagagacagttttcaggtacattgatttttgttgttgtttttccccccaatttttctttttctatcatgtatttctgttctgatcattaatatttcctttcctttgctttattgggcttgttttttttctgacttcttaaaatagcacatgtggtcataaatttgagtacttttttctaatatggcttcttcaaatttatgcctatacacttacatctagtgacattctagttgttctgacattttgtgctttcattggcattcagtaaaatttctaacttccaatttgatagctgctttgatccacatattacttagaagtgtggtgttttaatatttaattaggaattttcatgagaacttttctattaatgacttgtaattcaattgtcagagaacatactttgcactaattgagttattttaaatctgttggcttgtgttatggccctagatgttctatatctcagtaagtgttccatgtactcttaaagaattggtgtaatctgctgttaattggattctaaaattgtcatttttttctttttaccattgtaaccatttttaagtgtacagataatagtgttaagtatattcacattgttgtgaaacagatctccagaactttttcatcttgtaaaatgaaatcctatacctgttgaacaacttcccattctcttccccaccccccgcaaggccctggcaaccactattttattttctatttctattagtttgactactctagatacctcaagtaaatggaatcataccgtatttgtctttttgtggctggcttattgcacttagcataatgtcctcaaggttcattcacgttgtagcatgtaacaagatttccttcccttttaaggttgaataatccattgtatgtttataccatatttcattcatccattcctccatcagtggacatctggtttgcttcacctcttggccattgtgataatgctgttataaacatgggtgagctaatatctttgagatcctgctttcaaaactgtcaatttctttgatttggttggtagtgttcaagacttccatacgtttatggaattatatatttgttctatcaagttttgaaagagtgctattgaaatctttaactgtaacagtagatatgtatttccccttgcaggtctattgagtttttgcttcatgtactttgaagctccattactgcatacatagagtttaagatcttaatgtcctctcaacgaactgatctctttatcattgcaaaaagaattttttttggtctttggtgatattctttgttctgtaatttactttgtctagtgtcttgcagttacagccactttattttgattagtttagcatggtgtatcattgttattctacccacttagatatcagtgttaaagtttcattccctttaagcagtaaaaagataaaactgtattttttatccaatctgatggtttttctaccttttaactatagtgtttgtcacttacacttaatgtgattgttgacatggttgactttaagacacctgaagttggccatggagtttatgactggccattttcaacttcagtgtgaatacagaatatttatattcctgcatattttattaaaaattgaaaatggaaatctttcaattggtcacagaatggaaactaaaaacaaataccaatgtttgcttttatcaagttgatatggtttggctgtgtccccacccaaatctcatattgaattttagttcccataatccccacatgtcatgagagggacctggtgggaggtaactgaatcatgcgagcagttacccttatggtgcttttgtgatagtgagttctcatgagatctggtggtttttttgaggggctttccccccttttgcttggcacttctccttgctgcccccatatgaaggacatctttgcttccccttctgccatgattgtaagtttcctgaggcctccccagccatgctgaactgtgagtcaattaaacctctttcctgtataaattacccagtcttgggtatgtctttattagcagcatgagaatggactaatacacaaatgctaacctataattgtagtatttaaaaagagactataaattgaggcttctactgttaagatagaagcctagtttaaataagagttttctaaaatgtcttaattggcaaatcctggaccaattttatttttataggtagtattgtatgctatgcatgaagctagtttgataaatattggttaaattggattttctgaatcttcctggatgtttagtttaatacattttgtctcatgcccctaacattgcttttatcaatttctaagactatgtctaggtttctaattccttctaaagttttaaattggcagaatcattagaagcagtcggataagttatctgcagatccaggaaaattttgatttcactggtcacattcccaaggttgtccaatcccatattcttccattttacaatgtggcctgtaaaaaggaagataattttctcactccttccactaactccaaacatgaggaacctctttatatatttattaaaaaaaggtatgatagcttgataaagctggagtttgaattatggtaaaacaaaaccaaactgttttatgcatacagtaagaaattatatatatatataaattatatgtgtatatataaattatatgtatatatataaattacatgtatatatataaattacatgtatatatataaattatatgtatatatatataaaaattttgagacagaatctcactttgtcacccaggctggagagctgtggcacaatctcggctcactgcaacctccgcctcctgggttcaagcaattctccaccctcagcctcctgagtagctgggactacaggcatgtgcgtggctaattttttgtatttttaatagagatgggggtttcaccatgttagtcaggatggtctcgatctcctgacctcgtgatccgcccatctaggcatcccaaagtgctgggattacaggtgtgagccactgttcctggccaaaattttatatttctacctttatattctgtttgatatgattcctaagttattaataaatattgtatattttatatctaataagaattgaactattaacaaaattactaatatacacatacataaacttgagtcaaatggaaatagtcttgatatattccactcaattgttaactggtgggaatggatttatgatttaacatagaaggcaaatttaatagttgtttgcattgtgaagataagtccctgacagcatttctttttattgaaactgatagttataactactttgaaccatttacttatacatctatacatagtgatctttaaagacaaaatattgagtaatattataacatctggagacctattaagccgttataaacaataggtcatagaacactttcacagagagaactgattctaacaaattattgtactgacccatataattatctttaatacaagaagatatgatacttttaaaataatggtcagaacagaactataaaaggatttacccaagtatatgctgatgcatatttgcctgtgatgccctagtatgacagactgaggacaaatatgatgaacattactccagataaagtttcattttcagttctcactaatctagaacatgctactttagccaggacaagataggtagtttataggtctcatggtgaccacatcatattccaacaataactagcctttaaaactcagcagtttttaacagtagtttctcatgcttttcggtgattatatgctgaataatgtcctaatgttctgttggaatgcatagtttgaaaatatgagattcactgatgcaagtctcaagtaaaaccacattaaaccttcatccatgactaagtgtagttcttgcggggcaggagataggtgggaaactaaaggaggagagcaaataggacaatgctcttataggattgtattgaactacaagttcagattgtgtttctgagtttgctagtagtatagaaagccatatatgtatgtgtgtatatgtgtgtgtgtgtgtgtgtgtgtatagagagagagagagagaaacaatgttacacatggtagctgatctcaagccatctaaaaaagcttgtaagtaacatattagcattactatgcttcatatgacatacagggcacagaggataatagtactgaaattaatgttactactaattttaatttcccaggtgactggaaaaaatttcaagtttcaaattcagaattccaccagcatgattttctacttctagtacttcttatgaaagattgtattttccaaagatgactatacccatgtatacatatgaaaatcatcctatatacttaaaatgtaatggtaatatacctctattgagaagtacaatctatgttccctcttcccaaaactgggcgtacttttgtgacctctttgaccaataaaaagtggtagaggggtgttgcatgacttctgaggtctgaccatgagtggcgatgtggtttctcttttccttgaaagacttgctaataaaacggaaaggccattgtgtcttgctgagagtcccagctagtcccctaactgaccgtcagcatccatggtcagacatatgagtgaatgaggtttcaaatgtttctaggcctggattttaagtctctcagccatgtcccagacattgtggaacagagacaaactgtcccactgtatcttgtgaccaactgaagcagacagataattattctttcaagctctaagttttggggtaatttgttgcacagcaatagacatagttttatgattgtacctgttttcttcatggcaccgccacatttgtccccctggctacatacatttagccctaactttttgctacaatggcaaggtttaggagctctgacagtaccagttccagcactggggagggtaagtaagtttggaatgtgataaaagataccaggaggaataattatttctgcaatatcaattactacaagtatggtgaatccagaagtgaaggagaaagattagattcagcagcactttgaagcccatcaatatgtaatatcactatgaagttgctttgctattttgcttcaatagctcgtgattaaaataaactttattaaattctaatttaatgatctaaaatattattttactattagaatgcattagcagtgcttaaacattgaattgttattgccatttgttaagatttagaaaacacctgcttttaataagttggtactagcagtaggtctttatttgaagttgaaatttttccttaaggtgtttgagaaataagtgtacgaagcttcatttctaaaaaaaaaaaaaaaacaaataaaaataagtggtcaaatgaagttgtactcatgttatttgaccatagttaacattttacagtaaaaagagtagataatttgcagttggacagtggattttgaatatgtaggcaatattgattaaaacagtcaactagttaacccctttctcagtgacctgaataacccagtgctattgctattgtattgtgcattcttttcttgaaactccggagaaaatgctgagtcttttatactttagctaacaaattattggagaaaatcttgcattaacaacttgtgatttataggtaatttcttgtcagtgacagatttatgatctcttaatttttagccaggtctacttctgtaagtactaaactctagcatttattttttaaaattggaaattagaaacatttgacttaatgacggttgtcagtatcaatagaatgatagtatgagcagtgatctgcaaattttaaaaaatcaaatgacatggatttattatgttttagatgaccatattttaaaagccttatggaaacatagtccacaatacataatgtgttagagtctggtcagaattaaaacaaaaataaagcaattgccaaactaaaatttcatgcaacataactttttaaataagaatagagagagacatttccagtgacataagcaggtgagttttcttggctctctttttgactacctccgtgtgatccctattttcctgctagaatgtaccgccggtcaggtaaagtttaatattggatttgagtcttactctaccagtggtggaatacagcctatttatatacttccttagctattttttataatgctattcaaactacaattgtctgccaggaatactcaatgtttaaggttctaatccattccaccttctctgtgaaggccttcccttatcaccatctaagccacttcaatttcaggtaaaccttccacaactcacttccactgttaaggaatctcatgtatacctctcctagagctgtgtgattgtttttacaatatttttttctgaactcattgagggcagagactgggtcatttttttggaagtgacgttccatgggacagtgcttggaatatattacaaactcaataaatccagtttgaatgaattgaaccctaaatgataagaaggatattagagttttaccttaataagagcaaagagttaaagacagtgcaaggcataattttaatgcgtaattagacgagagaagaagggagtagggggataaccagtagatgagactagaaagctagaatggaacctttaaatccagctcatctgttacttcacctgggaaagcttctctaagcagggtgcacagaaatctgttctatgaactctttatagagtttccttaactgtctcatacaaatttttagatactatctggtattagtcatttgtggatatgatttatcatttccgttgaaaagtgaaactcttcaaggcatactatgttatacctcaggtttctggtcccagaaatacttactgttacagcttctacaagtgagtgttcaatcatcattagttacataaataaatgtatttaaataaaaaggcaaatagttattatatagaattctttaaaactggcttcagaaaggtcataaatcaaaaaacagtgacatatagtgaaattacatgctggacgttatttgtgaacttttcatttctgaaaatataattagaaataatatttatagttaactacatacataaaactaattctagaaagaaaaataatgccagctttctttgtgctatgaagactaaagtaagcattagctgtctgcttttatgagaatttttttcccctttgttataataaaaatgtccttcaaatcctcaggcattctgaatttctagaaacaaaactgagagcatttaaaaatacacgttgttagaccatgatttattatagtaattattttctaaaaacagaaaacataaaagcacaggacctgagggcagggacatctttttcatccttttggccccagcttagtacattgctttcagagaataggtactctattttttacaaagtatactctatctgctgaactgaactaaactgacacacgcaaaagagtgaatatgaacatatacatttatacatgtcaacatgtgcatgtttaccacacttaggttaattagaaacattttccgttggagtaaaaatacttgctaacgttcatagtaaggaaaagaatggaaagaatacattaggaacctattatatataaggcattgtagaagatactaagaagcataaaattcctaagaaatttccactttaatgagaaaaatagcctatgtatagaaagttaagcaaccattaaggataactaacagtgcaatatattaaataggtaactactgagttgtgatcattatttgtgtttccactcgtcatctgttttttcaccctttttaatatcatcctggtttcctcgaggaggagcactcttttctacctcggtaaggtggaatagcaaggtgcttgtgtttttccgttagagtctcggtagtatatttttgttagataccctttttatactgttgacagccaaatgacagacaggtgatcctggccaatagtatctctcacctgggacattgaggctaaattggtacaaggttaaaacattcataaatgatgagctctgtcaaggtacctataagcttgcgtagtggtcccttctgatagctgtatgttcctatctagtctgaggatggttgtgttaccagtggagggtcttgactatgggtcatccaggctcttggcattttgaacaaagaattggacaaaatgcccaaacaaaacaacaaaagaaggaagcaatgaaagcataggtttattgaaagggaagtacactccatggagtggtggtaggctccagcaagcggctcaagagcactgcttacagaattttctgaggtttaaataccctcttcccatttgttagttggttacaccctacgtaaatgaaggagtggcccaccaccggtctggttgcaggaggtgacccatcagaagtcctctccattttttaatcttcaggctgaaagtgggggttacctctgatccttttgttacttggacatggagaggtggggttttctttttgattcaattctaggaagtcagtgaatattgagcttaggttccctgccttcagaccctattctcctccctcagttattcaccctttccctcaatcctctgagtggcctttcatcctgctagtaacagctgcaattgttgaaagttaggcaacattgcttgttttgttcttgtttctatagatttttttgttgttaattcagctttttaaaaatcctgattaaaataattactaaatacttctagtaaatactagaaaaggtcagaggtaggagagagttctatgctgcagtgctctgaaaaaaaataatttccaaagaaatatttgatgtgggactttgaaggatagatacaaattgaccaatgttaaatgaagaaggcaggcaggctttttagtgatgaggaaagcctggtattaaatgttagaaactgaagatcatgaactgccactgggagagagagtaagtagaaataattttatgtggaactacaaatgtagaatagaaaaggggttgagcacatatgtttaaaatcctgattctgggtttaagtgtttggtgtttatgacataaaatatttgaagataaaaccaagttagaatgcaaaagagtaaagccctactttagataagaaacaactaatattagctacagatcaataaaatgcacttttaaaatatttttttgccttgctattgagtcttgtttcaaattaaagtatacacagtacacataataatcaaagttggtattataaatatataaatcctatctaaattaagaatattacatgttttctcttatatagaatgagagaaagaaaaagctaagtcttctgaaatcaatttttgagatttcatcttaagattggtagacaaggaaaaatgagacaagaagtaaatcacaaaattacgaagtacaaggagatttttgagaattaaaagagaaacttagagcttttgatcataaaggaaaaaaggaaattgcatccttctgtacaattacatcagtattgatgtataatccacaccattcagtatctaaaatttgactgggcctaaaatagctgctgtgatttccatgctaaattaacaagataaattacagagcatcattttattgctattgttgatgaaaagtaaaagttgcaatcaatcatctaaatgaattttggcattatggtttgggcaaaacatctggatttggatagacatgttttggtttttattatctgcacaaagttacactcagatttccatactttttcttttagggaatgtatcctatcaatatgttttccaaggttttaactactaattactctggttttgattaaacataacacaaactaaataatggagcttagatattagataccatcagcatttgtgctgtacaaatggtagccattggccatatcttgctacggagctcttaaattatggctagattgaattgagatgtgctctaaatgtaaaatacatactgactttgaagacttagtatgaaaaaagaattatacatattcatataaaagataaaatatatatggctaaaacattcctgttaaagtaatttcacttgtttctttttactttttaatacggttactagaaacttaaaattctacttgtggcttgcattgtgtgtctacttgacagcactgatccagagcctgaagtaatgaaatcactgtagttgaagacggaaggctgccttctctctcctacgttctctgatcaaataacctggggcctaattgtggacacaaattgcttaattgtaatcagtgatcttggtttcttctgggaaaccagtatctaagcacccatgattgttgctcgtatagcgaagacttggcaatgaaaatttcatagctcagaatatggggtcagtgttgatagatgaagggttttgagcctccccctccatcttgacccataggcaggagaggatacgcttatttcaatgggcagtgggactatgtaggggctgcccaggaaccgtgaggcctccatggcagggcagtcatgaactctgccttcactcctaagatcagttgagtattggatccataagctggctaagtgcactggcttgccattggattaaaaaaaatgcctttttcagtgacagatttgttttaattcaagtacttagactgtttttttttaattgcaaagcatcaaaattgggtttgaaaagctgcttatcttcattatgttttcccagggggtggcctaagattccccatgtcaccgtatgtacagaaaacattattttgaataaatgtgaattcgcaagtgccattaatcaaatttacaagatgattgttttctaataagctttgcctgtcaactttcttagtaattcttttacaccccatggtgaaaatgacccatcatgcaatctgttgatggcattcattgaattagaattaggcttataataaatctcacatactttaaagtacagtaatcaagaggatatgttacttagcattcagcatttccatctgttgtacattggtaatcactgggtatttcagtccagtgcaagagcatatatctgccctgcctacacatctaaaaaaataggcaatgtatttgtaagctcctcattttttgcgttgtaattcaaaacattttccaaagaaatttttaagggataagcctatataacatgaatactttaaatgttgagacagctttttatttaagtcacctacctacacaatgtaaaatcttaaatgtaggtagtccttgttttgcatagtgtcatgttactgaaagcttgcgtagatgggaatggagtcctctttcgtaggttccatggtaactagcaattgccaaactgtttaggaaagccatatgcctaactatgaaacactcaaaattcagttagacacattataccattaagtataaaattagaaataaagacaagtaccatcgtagataattgtcagatattttgtgccaaattttatgatattcctaaatccactggagactcccgaactgctatggatttagagagaaaagtcatcttctcagttgtctttaccgttttatctcttctttcacgtttacgctacaaaaaattgattataaatctggttgctgtgcagactaagcatggcaaaatgacacagcaatttaggaaatgttttgtaaggttcttggtgagctactagagtcaaaccaatggagtggcataatgtcaatttgcaccctattgacaagtccagatttactcactttgataagattcttctgtagataacttacatttatcctaaaacataaatctccaagctttatgtattagtggagaggattttatatgcagagaattaggaagcaatgaaaactaccgattttaatttgatctgtttgaaaatattgagaaggtccaatgcaatataaggctaacatccacctccttgttcctataacgtgaccacccctcatctagcatattttcattcatcttgactcctttgccagtacaaacaacctaaccaaataataatactgaattacaataaattgccaagaaatatattatttccctgagttattttaaaaattctcataaccttatgaagttggcatcataattatgtcattttttcagaagatgaaataaagcttacaggaaatgatatataaaaattccacaaattacatgaacagcaagtggaagagttaaacctgggaacctgaacggagccagtctaattccatagcttttcactgacatgctatattgcaactccctgttccttgtgaagaaatccgtaactcatcttgggtttctggtgtgttattatcattcatattctctctcatttctttattacccattgtttctttcatcctttataatttcgtcttatttttcaaaattttgctgaaactacaaacctcccaaatttctgctttctcattaccaacttagcctcattctttttggctttattcaaatgacatcagatacaattaaccaggttagcctcttaaacgtctctccttcattttgacagcagcatattaaactatttctctttcctttttcatagtgcttgtatttctcatatgctggctctaactacaagtatttctgtgttttatctttgatcatctttttggtaatccattttaatagcttcagctcttgtttctaagatgataatgccttatttttaattgagagtcttaaattctcattggatgtctgttctaatattttgaattgtctgatgttgacttccactgggacacttctctactgtattccaaggctcatctaagaggaagattttttcataaagaaggcagttgctccagcactttgctgccagattaatagacacaagacagcattctcaacatctctcttccctcttaagagcaacaaaaacaaaaataaacaataaatatttactctttatatacttgtctggattttcagacctagtttaatgtgacatttacttatcaatccctcttcacaatacttcctcttattgcattcctgtgttctcccatgccccatgttttcctttctttttccttttttctctcatctcattgtccaaaaatacatcatcttcactgcccataattttactcttttttttgtttgtcatggtgtttattattcttcctacttatccaagtttttgtaaattgcattggcaaaagtgaaaaccaatatcctccattaagcggactacttctctgccgcctcttcatggcttttgaattattaaattgtcctggaatacttgtttgactcttagtataagagtgcatgttaacatttgttaaatttgcatgtgtgttattcattagttctcttatggtgacaaccatttttttctttcctattcctcctataacgcagcagtgctaagcacacaatatgcattccagtaaacactcattttgatgaattcttggtcatcaaatacatgttttgtttctcagaaaactaaatggggagttagctcttattctatgtgatgttgtgacaagaattctttttaaaagtgacatgttggttacataactcctaagttcttcaatgaattctgatgactttttacttaaaaacccaatgaattataattattcagatattctagaaatactttgtacaaggcttacttctcaaccacaaattagacatgcataaatatgaatttgaatgacacccatttaacctaccttttctgtaaggttactactttaagccattcatttatttgtgactagctaccacttagctgccatataatagcatttatatacactgtcctcgttctactgtcttttatccttcacatacccttggttgcatggcatcagagacttaccgttacatagctgcagtggcttattcgtgtaactctgttacctatggcgttttgtattaatttgtattcatttttgtcaataggaagataatttaagacaaaaatgaagctttgcttttctctaaatgccctgtgggtatattatagtccatccaaagatatttctgattatataactgcatttattgagtataaccttagcctgacagtgaaagagtgttttcaccatgtgcaagaggccatttgtcaaaactgaccttttctgtgaaacggctacaattattagttgatccaagtgtcaaagctccatcataagataaggaagtcagctaggaaattttttctcatttgataataggtttccaaaagagttagagatggatttgatgtttctgtctagggttgaaaacctagcctgaaatgtgctcgaaacaatttagatagccatctttgttgaactgagttacacatcacaattttggtcttcttacagattgttcataaagtacactctgagcaatatcttattttcatttatgttttaactctaacacataagcaatatacaagaaaagctttataaaataaacaaaacttctctatatgatacattgttttacagaatgtgattttaagcaacagatgacaatgaagtcttatgaaactcagatacagatataacatggatgttatattaatgacaatttataatttactgtaaaataaagtgccatagttctataaacaagataaatagtataaataaaaattaataagcatgagaaattcaaaaccaataagaaaaacttcatcaggaaaactttcaatgggactaacaagacaaatttcttcatttaacagactatagacatccttctacgtatcagcacaatgcttagatgtagatggtatgccaagattgtgagggcttgcacagattttatagaattaaaacataatcacatgaaatagaagtgttaaaataaaactttttgattggaaatagaaagtgtcaaaatgacactctcaagtacaaaaaaaatggaacaatgggaaaataaagaagcagaaagggagaaatttttaaaaggcaaaacaaaagaattttacataaaattcatgaagtgtggtaggcctcaagcttacttccatgataaaaatgtcccggcaagaaactaatgtgccttgtaatggctagtgtagcattaagtcagccatagggagagctaaaaatgaccttgctaaatccatctttttgctgtagaagatgtcaccttgaagttaagaatagaaatatgaacatcatagatacatgttaattatgggtttgtctacatgaagataccaaatgatacagaaataagtatattggaataaaattggcatgagtaaatttctaaatgccagtaatttttaaaaattaagttttatttttaactgacaaattgtatacatttatggaatatgatgtgatgtttcaacacatgttacattgtaaaatgatcaaataaggctaattagcatatcagtcacctcaaatatttatcatttcttggtgctgagaacacttaagatcctctctttcagttattttgaaaaatgtaattattaactatagtcatcctgctgtgcagtagaacaccagaatttattcctgacatctaattgaaactttgtattcattggccaatgtttccccatttctctgtcaacacccctctaccctcacccacctctggtaatcaccattctactctctatcagttcaactttttatattccacatataggtgagattatattgtatttatatccctatgcctggcttattttactgaacataatgtcttctaggtttatacatgttgcaaatgacagaatttccttttttaaggctgaatagtattccattgtgtatatatgtcatattttaaaaatctatttgttgatggacacttagattgctttcaaatgctggttattaggattaatgctgtaataagcatgagagtacagatatctcttcagcatactggtcttaattcgtttaggtatatatgcccaggagtgagattgctggatagttgagtaattctattttaagatttttgaggaatctccatactggttttcaaaatggctgtactaatttacaataccgaaagcagtgtgtaagtattcccctttctccatagcctcactaacacttatctatcatctctttgataataagtgatctaataggtgtgaggtgatttctcattgtgattttaatttgcatttctctaatgattatagatggtgaacaaattttcatatatctgttggccatttgtatgtattcctttggaaaatgtgtattcaggtcctttgcccgtttttaatagggttatttgttttcttgttgttgaatagtttgagttccttgcattatataatctgggtattagccccttatccaatgtacgatttgtaactattttctcccagtgtgtgggtggtctcttcattctgttgtttcttttgctgggcagaagctttttggtttgattcaattacatttgcctgtgttttgcttttcttgcctgtgcttgtggggtcatatctaagaaatcactgtgcaggccaatgtcagaagtcagcgagctatttgtctatattttcttctagtaattttatagtttcaagtctttaagtattcaatccattttgagttgatttttgtataaggggtgaaataaaggttcatttttattctttatatggatatccatttttccagcctcatctatttaagactgtctcttcccaattgtgtgttcttggcaccattgaaaaccaattgactgtagatacttgggcttattttggggctctctatcatatttgtttgttcaatatatcaattcttattttgtcagtaccatgcggttttgattaatatagctttataatatattttgaaatcaggtagtatgatgcctccagctttgttacttttgatcaagattgctttttggctacttgggatcttttgtggtttcatgtaaattttaggatttcttttctatttctgtgaagaatgacattagaattttgatagaaattatattaaatttgttgattgcttgaagtatgaatcttaacattcttccaatccacggacaagggatatctttccatttatttgcgttatcgtcaattcctttcatctgtgttgtatatagatctttcacttccttggttaagtttacttctagcttttggtgtattgtaaatggaattattttctttttcagacagtttcttcatgtatagaaatgctactgacttttataagttgatttttgcatcctgcaactttactgaatttctcagttctaaaacttttcttgtggagtctagacttttctaagtataagatcatgtcatctgtgaacaaggctaatttgatttcttcctttctatttttggatgttctttatttatctttcttgcctaattgctcaggctaggacttccagtaatatgctgaatagcagtggcaaaaatggaatccttatcttcctgatcttagagataaagccgtcaacttttcactgagtatgatgtcactgtgggcttgtcacatatggcttttattgtgttgaggaatattccttgtatacttaattcattgagagttgttatggtgaaaatatgttaaattttgtcaaatgcattttctacatctattgagatgatatggtccttcaatctggtaatatagtgaattactgtattagtccattttcaggctgctgataaagacatacctgaaactgggcaatggataacttgttaaaagaaagaggtttaatggacttatagttccacatggctgaggaggtctcccaattatggcagaaggcaagaaggagcaagtcacatgttgcatggatggcagcaggcaaagagaatgagaacttgtgccgggaaactcccattcttaaaaccatcagatctcatgagacatatttactatcacaagaaacagcataggaaagatccaccctcatgattcaattatctcccacctggtccctaccacaacctggtaattatgagagctacaaaatgagatttgagtggggacacagagccaaatgatatcaattacatttattgatttgcatatgttgaatcaaccttgcatcccacggacaaatcacttgatcatggtgaataatccttttaatgtactaaatactgtttatcagtattttattgaagatttttatatctgtgttcatcagtgatattggcccatagtttatttttcatgtaatgtctttatctggttttggtatgagggtaatgctagctttgtaaaaggagtttagaagtatttcctcttttatacatttttggaagaatttgagaagaatttgtattagtttttctttaaatgattggtagagatcagctgtgaagccatctggtcctgagcttttctttggtggaataattttaattactgattcaatcttcttacttattatggtctgttcagacttgaaaataaaaatggaaacataacatacccaaactaatgggatgcagtaaaagcagttgtaagagggaagtttatagcagtaaatgcttacatcaaaaaagaaagatctctaataatccaacattacacctcaaggaactagaaaaagaacaaacttagcccaaagttagcagaagaaaaagagatcagagcagtcataaataagggactagaaaaacaaaagataaatgaagagttgtttctttttaaaagtgaaacaaaattgattaaaaacttatagttagacctagaaaaagacaagactcaaaatgagaaatgaaagaagagacattaggactgataacacagaaataccaaagatcataagagacttttgtgaacagttatacactaacaaattagacaacttaaaaaatggataaattcctagaaatattaaacctatcaagactgaatcatgaatattggaaatctgaacaaattgttgatctaatccctcccttcaaggatgctgtgtcttattttttttgaggcagggtctcactctattgcccaggccagaaggccagagtgcgctggcacagttttggctcactgcagcctggacctccccaggctcaagtgatcctctcatctcagcctcctgagtagctgggactacaggcatgtgacactatgcctgaataacttttgtattttttgtagagacaggattttgccatgtgaaggctgttaccctgaaaagtcatctctccctagtttttgctttgaatggtacagtaaatcatctaaatcttctgcaaactgaagctgaaggataatcataataatcaatggataacttatgattattccatgacctgtacacattttgtttgaaaatattaagcactccttcaatgtcacttataaatgaatagaaaaatgaaaaatggtttagtaattatctatactgtaatttgaagcattggtaacactaagaactaatgtgttttatttcattgtaaaaaacctaccaggagtagttttgagtagtgtttgcctttttctcattgcatagcttacaatatgaagcaaacatctttgcctacacaaattgtcatactcctttctgagtttgcatcagctttcaacattttatcttttgtgccttcaatgttgtataatatctgaattcctttaacaagaagcttttctcccaattttcttccttttaataataatcactttccttacttatatgtaagttcacctttatggcatttttttctggctgcaagtctagagtctcttgaacaacagctgtgtcaaaatttccaccgtgtatttcttccactttcaatttctgtttgaatctttagccagttcttcttttcaattatgcagttttgtaaagatgttcagtttatcactgggagtaaaggaggcaacacaactacaagctttactgtctgtgcatgaactaaataacagatgtacagtgaggagccaccagtagactttgaagtaattcgtgtggtcatggatcatgatgcacatgttgtttatgtagtagttttcatgctaaagagctagcagcaaagtttatacttcatgcaattacagttaacataactatacagttaacacaactatgctaactgaaatttaaactgttaggtaaaccacagtaacttaggttcaagcatatattgaagctatgcaaagtacagactgcctctgtgtgtgtgtgtgtgtgtgtgtgtgtgtgtgtgtgtatgcaattttgtatgctctcttgtattgtttggcttacgcatgtctatcttcttgtaagcctcaaatattctgtccctctctctcagaatgtaaccttaaaagctgcatagttgttttaaaaacacctctaaatgcccatagtttcctctgaatcaacttttgacatctccacactccttgtgatgttgtcatatgatgattttaggattttcctataatagtctctaaagatattttatactccccttttgaagagtaccttttgctggaggaaaagatatggaaagttgggcaattggggcacagtgagtcatttgactcacacagatatgaaaagtctcaaattaagctgtaacttcatctttaaatgctcttatttgtacaatctgaatatacacagacaagatttagataatattactatttttattttaccaaacatgttcgttttcagactaagctatctgtaatataccattaaacccatatttattaaaaatatttcaattttaatgttttgttaaaatgtaatgtacagacataccaatgtgtatgcttcatatagaatgtgtatatatgctcttactacatacatattacattatgccaacagcagcaatttaagtatacaatttcaaatacataaaattcatttggttattttggcatcatttaaaaatcttgggtactcacaaaaggaagaggctctaggtttcttttctgaaggtgtctttactaacacaaacctcttagtgtcatagaattgcagagctggaggagatcatggattatttgtatacatctttcactttatcaatgagaaaatgggaaatcaaaaaagataagtgaaacaaaatgaaagtgggatcatattttctcaactccacgtagtaaaaatacctctgtgatgtttataatctgtaaattagactttgtgtttatcgtttaattctcacaataaacctctgaagtcaggcggcaggaattaacgcatctgtaccaatagaaaacagatttaaaggagtcaaatgtcttccctgaggtgacacagctggcgggtggagaactcctgacgctctcatctcctcattgtggagcccaggctttatctgttacccacccgtggcttttgtaatggaaatggaaacagtgtccatgcataggtgtagaatctcatttacagaaacaacgacataaagcattgagtgattttctgcataagcctttggcaaccttgatgtttttttttttttttcctaaggttggcaggtgttatcactttaatctgcaaaatataatttgcttagaaccacttttaattcagggttaggccaaaagcttcctgtattcatatagagtgaaatgattactaactctgaatgcagactgtattccttttaaatcattcgtgtactgttaatgctttgcatgtagagcagtctaggtgggctcagagctcagttatcctgtgtctcttccttcccacttctaccactaacttgtgtggcagtgcctgcactcattggttgactcctccaaagggctcctaaacattatagacaacttttcattatgttgcatgcatatattcagaatttcctttctacaaaaatatgtgttatctaggtaagaaagatagatatgctaacacagatcacatacatttgttaaggaattaaaaatggtattaaaccaagtacgtacaatatctatccttacttaaatatcttgtttttttgagttctctgtattggtactatgaatataaatcagccatcctaaaataagaggatgcttattataaaatggtgacatttctaaagcagtgataactgctatctaagttacacctgtgatttctccagtgcatctttcatgctcaactaccctgtatacgaggcttagatggttaaaatctttgtgcagaaaattacattgtctatagcaaatttgatgtgataagtgaatcataaaagtaactttgagaccagatgtgatggctcacgcctataatattcccagcacttgggaggccaaggcgagtgcatcacctgagttccagaccagcctggcatggtgaaaccccatttctacttaaaatacaaaaattagctgggcatggtggtggtcacctgtaatcccagctacttggaggctgaggcaggagaattgcttgaacccaggaggcagaggttgcagtgagctgagatcacaccattgtactctagcctggtcaacaggagcaaaactctgtctcaaaaaaataaaaaaataactttgatccttttgtcaagacataataaaaccagtggtaaacttaatggagtaaacatttgcaggtatgtttgtggtattaaagtatttgcgttaaaatgccaggatgagtattttacatagaccttttccagtaacaatatacaatcaacaattttccctttgttcatcataattataaaaggtcaaataattatactttttctgtaaatggtaactaatttcaatagaatttataagtgtttccaatttttatgaaactttctaagattcactatttagaaatatttcacttaaacttacctgaattaagtttggcaaatcatgatttgtcaagcagtccgttgggataatactggacaggttatctttactccagcatggtttggtcaccctctcttacattaatgtcttgaaattccactcggagttagctgtatgtaacaagcaattcgtttaaggtgaggatccttacttaaacatgtctgaggtttgcgtatttcctagaggctcacgttaaatccctccaagtctaatgaccttgccacctgcttcctcacagaaaactaacatttacatttgtaaggttaaatcaaatatataacgggaaaagtaggaggaataactattataaatcaaagaaacatattataggttttctcatcttccctgacaacttaaactttcgtataatgatcacatcaagaacaatatctaatcatgagttgtctgcatattgaggttgacaatttcagttagtgtgacaaactgaaataattgttttacataacacataggcttttaaaaaatgagattattctgggttatgatctcaagaaatatgttatactattcctgccaccatagcttccacactctgtaaagagatccgaaatatgctgtaatagtatggcaccaagctggtgagatattttggataagataaacaagtgcaattgaatagattcatttatttttgataaaattctaagcaatgtccgttgtgaggaaatatgatttaagaaaaatagacttgtaaatgtatttaagcgtagttaataaatgaaagaacacagaacaacttttctctcacaattgtaattaactaactaattaatttgtttgtttgagacagagtctcgctctgttgcccaggccggaatgcagtggcacaatctcagctcactacaacctcttcctccccggttcaagtgattcttctgcctcagacccctaagtagctgggactacgggtgcatatcaccgcgcctggctaatttttgtatttttagtagagacagggttttcccatgttggccagactggtcttaaactcctggcctcaggtgatccatctgccttggcctcccaaagtgctgggattacaggtatgagccactgtgcccagctgtatctcacaatttgaaatagtttctaaatgtaattgtttttccctgaatctcctgttccccgcaaacaccctcatcttgttataactctgtgcctgggcctttgggtttacaaatctcagtaagagtccatcaaacctctctaaggcattggggattttaaaaatatcctcatcttctcaattttattaatttgcatagagtgcttacagtttccttttgaataattgcatttctatgacaaatgtaaacaatttgctataccatgtcttacttgctttcctggagaagataactagcaatttagtataattttcattctcaccatagtttgtgtgatcttctgtttttggaattctagacatttgatgttaatatgaggccaggttatctttattccagcagggtttgctcactctctctcaaatgtctcatctcacatccaccctgcactttgagctacattgactgttgttggttgagagagttgacatggctactcagcatccttctgggaggcaggtaaactgttgtcccctgttagaattagcaatggtataggttgatttattttcttcattgtaaggcattctaattcaactagttcaatttaaattatagtcaacattaacagaatgatttcatggaatctcaaaggactttacacaattaaatctgctcatagtgaatcagttcctattgtattaacagcaaatgacttcttttaccagaagttgcattctagggcagcaggtcccataaccttaaaagtggggaaaaatgtttttggcactttgtgatatcatcatattccaagatataccagaaaaatcaggatgacaaatggttttctctcttcaatggcatttataaatttcagccacattattatttttatcttatctatcttcagctatcggcttatccagctgcctagacttctccttataaatccataccttcattctttaagtgatttttaaaaaatagacttttcttgtttaattccagaagaaccagatcctagctttctaatggcatatttctctaaacacataaaaagatttatattctatagcttaattatagtgaagaaagtagttttcatcaaaagaacttggttaaaacaatatatttatggtcttaagtatggctagatttggaatgtgttaagagttaccacggtatcagtctgagaaatgttactgagtgatgctatgaggattggtgttttgacctacacaatacttgatgctttagagcagtggtcccagcctttttggtgccagggactggtttcattgaaggcaatttttccatggacctggggggtgaaggcttcaggatgaaactgtcacttcagattatcaggcattagttagattctcataaagagcactcaacctagatccctttcgtgtgcagttcacaatgcagtttgggcttctatgagaatctaatgctgttgctgatctgacaaggggcagaactcaggtggtaacgcttgctctctgctcacctcctgccttgtggcctagttactaacaggccacgaacctgtacctatctgtggcccagggatttgggactccttttttagagttaagagtgaagcatattctcaaaagatatttgcagtataaggggatataatggtgtgttaggatagtatgatggcaaaatagctactatcatgataaattagaataaaagtcctgcaatattcaatcgtgagtgttatgaaataatagagaagcaataccaacttgtatttgagacagtgaaaaattatacctttttaaacctaaagagtcttatttaaggaattatctctacatattttccacaattcttttttttttaagagctagggtctttctctgactaggctgaagtgcagtggcacactcacagctcaccgaaatcttgaatcttgggcccaaggtatcctcccaccacaacctcctgagtagttggaactacaggcatgcaccagaatgcccggctaatttttaagtttcttgtagagacatgtcttgctatgttgctgcctaggctgatttcaaatgtttggcctcatgtgatcctccctccacaacctcccaaagtgctgggattataggcgtgaatcactttgcccagcctaaccacaattctaatctagttaagaataatttggagtcagactgttggagtttttatccttgtggtaccactgagggcactggataaggtattttgtattcctgtttcataatttcctcatctacaaaatgaggattaaaatcgtatttcataaagacactataaattatatgtgagagcatatatgtaagccattacatagcacgagctcacaaactttagctaaaattcctttcattattgctatgtgcaaatctgaggaatccaaaattgaaaacaacagcaacaacagaaaatactgttcttttccaaaaaaggaaacctgccaacttacagattatacaagatagtgaatagaaagaatgtattttatagtgactgaaattcgaaatctgtgcttgggtgttacagcaaatttagatgatcgaaagctctcagattagaactctgcagatttatttcagtccagatatttgatattgcttgaagcagttgtttttgtggttcataattttcactaaatcaaaccttaattaaaaagtttctgcctggagacgcttcctttgaattcctaggcgaggctcagtaggactgttgcctgtttgtgacaatattaaatgtcaggctgacaaatgtcagctcaacagatgggtaattgtatacattaaccctactaatggacagatgtgttttagcataaattgtaatataatctgtgactaaaaccatagctcatataggaataatcctatttacaaatgataatgttaacatataatacacatttatacagtactagttcaataataccattatacataattatgtatgagcacttcttaatactaggaactctacattaaacataggtgtcttagttgcattgctgaaagagtctgagagaagggccacagttcttatttgagacgtgactccaacaagtaggagagaagaagcagggaaggatgagaatgtgatcagtgtcatcctagtaggcaccagggattgaattttgcagggccgtcagagaagcatgtagaatactccttagaattgcctgcaggccgtggcatttgtccagtggcagcttttccgtgtcggttgagggtggtctccagtgctgctgattatccctcacttctataatgcatttgtgtcggcccagtcagaatctcagactgaagatgactctacaacagaaatctgaaagtggttggaaaggcgatggcagtggaacactaattttgagggccagtagacaagtaattctccactttggctgtggataaaattggaggggcccaagggaatgaggaggggcagcaatagcatcttctgttctgcctttgttttgcctgcccttggtattgctcagatctctcactaagtctactccattaccaagcctgtaagatggtggccagccacaatttattagacttcttatgggaagtgtgtgcaacaagcttgagtcctcattgttgcagttggttcaggggcaataaacagtatatctcttttctgatcacccatgctggatttccctccctcttgcccaacagttcagtttgctagtgaatgcaaggctgaaatggaagaatgcaatcctgaattttatctctgggggatttgacctcctgtcaggtcatgaatgctgtaatttgcctttcactgctgtcagtaagcatagaaacaccaacagacgccccggggacttctccaggttccaggctacttatccccagcaggtagtcacacgaccctagaaactcatgacattcaggtccgctacgatcaccagcgtaatctgtgcctataacaggttcggtagtaagaagccacagttggcatctaagacttgctcagaaggagcctgtgctgttttgcccatgcgtcgtctctgtctccatcgccaggacagattcctttgtgggtccacagcaccagaaccaggatggccgaggaaaggggctggctgaaagcctcaacaaatcatctcgtccaccacacatttgacagcctcatctgtgcagaatcctttctgatggacactgacacaagacacagagattctcatactttgtagtttatctcaaacgcccatccacatatttgttccacaaacctcctggtttaccatcgtaatcttgctattttgaagaccacgtccaaacagcgaagacatttgcctctgcctaggagttcacatacacctttatgttaggctaattctgcctctatacaaagtcatctgagggtaaaaaaatgtggcattaaactttgttgagtaggattttctaatcatcacctttaatgccacctgtgagtctgtagtagtttactagtgtaaaacattaagctgtactgtctcccatgtatgagccagataggaggtcctcctgccccgtatgctagtcacaggggacctctttaatgacacaggttgtgctaagaaaggagccttggttcaagagttcagaggcatagaagttctctgtatcctctttactgactttaagactttgtaagacatttgattcatcttaagcctgatcaccaatgtgtactgtgaccattgcatgaaggatttgtgctgtacccaactgatcttatgacttgaagatctgatgatactcacctcatcatgggaagctctgatcttagtcactgatgtcccatgatcagatgctaactcatcatgaagaccccgtggcatgaaaggagccatttaccaaaggcatctttctctgccacaaagagcatggccttgctctaaaatcctagcagtttgtactgtgactctcctataaggccctgccagagacttttcagtgcatctttatttactgtggctacctatggcagcattgacttttccaggtcacatagctcaaatggcaggggttttgcagcatagtctagacctgatagagtcctctcttgttctgggacccacttgaaactgacagccttatgaaccaacccataattgagtcatagtattttcaagggtggcataggctgccgctaaaatccttgaggggcctgtcaaagcactggagctcttgctttttaatagggagctcaaggtatactaacttgtcctttacattggaggtgctgtcttaaactgtcccaggtcattggacctctgaaaacttcaccaatataaaaggccttgccgctattccttggtccagtttccatacactgtgccagcatgaagctctatagaataagatgtcaagtctgtagaataagatggccgaggaaaggggctggttgaaagagaggcaagactgtgaatgtgtactgctgccctttccacataaaagcaaactgcttttggacgaggcttgaacagactgtattcattatatcaatagctatatactgagttccagaagttgcgttgatctattttaataaaatattacttccagcacatggctgtaataagggattctacttgaagtttcttttactttcctgtcatctgccataatttcatttataaagggaccataaatgttaattcaatagtaatatattagtaattaaaatgctatcatattttaagtctgaggatgggattaaactttataaagccacctgatacagtattgcttatgatttattaggctggagggtggaagttttaggggcttctatttggtccttcctgctatagtgattcttttagggtcaacatatcaagtgaggttttgataactgccaagtgtattcattccagttatacattaggggacgtttgattcactcagacccattggacctacttgcttaactgtagtaagatagaatacttgggctactatgtatgtcatttatctactcgattccatcaaacctctttttttttatttttttctagacagagtcttgctctgtctgcaggctggagtgcagtggcgctatttgggctcactgcaacctctgcctcccgggttcaagcaattctcctgcctcagcctcctgagtagctgggactacaggtgtccgtcaccacacccagctagttttttgtattttttgtagatatggggtttcaccatgttggccaggatggtctcgacctactgaccttgtgatctgcctgcctcagcctccctaagtgctgggattacaagcgtgagccaccacgcccagcctcatcaaaccccattctaaccagggtgctactatggattttgggaggcgtggggaaggaaagaggtcctataatgtattggctttctatttctgtgacacagattttcacaaacttagtgacataaaacattataagcattatcttactattctgtaggtcagaagcctgcacatggcatgattaggttttctgttgagggtttcacaaggctgaggtcaaggcatcagttggattgtgttcccatctaaggctggaggcaactattggtcctatcagtttgctctttcttccaagctcacttgtaattagcagaatccattttctagcagctgtatcactgagatctgttttcttttattgctgttagaaggagaccatgctccattcctaggagacaatctcaagtcctagctgcatgactccctttaaggactctttcacaatatgcacctatttcttccaagccagcagtagaatttctatcatgcttccaatttccttttttaagaaaggtccagaccttttttagggcctacctgattaggctaggcctactctggataattatccttaagattgatttaggaatcttggtcatagctacacaatttctttaacttgtcacatgagataacccaactgtgcaagcaaaatccatacgcccagtcccaaccactctcatgaggaaggattacagattatgtctacgatggggcaacaatcttgaaagccttcctataattttttcgcctactacacccaatattgttaccagctcagacactgtattatgcagccttatgaaaagtttgtgtatttcccttataagagactacaataactcagataaatggctgcaggtcccattggagaaagactcactactcacattacaaagaccagtttattggtgctatcgtctactgagcaatataggaaagtcataaatattttggtgatatcgctcttttcgccagtgctgtattgtgcaactaatggaatggaaatgattttgaggatgattaaaactaacagcatagcaagaaacttgtcattggtgtttctaatttctatatggaattatagaatggtagatgacacttcttgctgtggtctgaaaacaagaagtcaaggtacatacatgcaaatactcctgtacatgttatacctttagctgtgtaacaatgagcaagttatatttcctcctaagtacaatttatcttcaaaatgaagtgtctttcggatgttaatcttcaatgattccaacacacgtggtgttttctcttaacttcttggcacccgatatgttcctactccgtaactccccatttatttgaagatagacaagtgttttctacttgagccacagagtttgacttatagttatagaattataccccattaagtcaattgggcaggaatttctattaaagcaaggtaattttctgatgttttttctgcaggtctagaaaatagatattcagctacaatgtataataacgacaatggacttaattatagctgacatggttgtaaagaacagagagaaagctctaaccattctagatgctcatggactttatatctcaagtctgtggattctggcttagtgagctatttgggataggtaagcaaaacagtatgcttttgaaaggcaaattttcccagaacaaaattttatctgacaatgcaattatctagagacttagttgactgcagacatattgacattatatgtccacatttagagatgtacgaagccttgtgaaatcacctttaactgtgtcatcatttatgccctgggaagtcagctattaataaggtaaatgctgcatctcaaaatggagattctcagttgtgtagctgtggctagttactcaggtgggtctcagaacagacttaatgaaaccaagatttcagatcattttgttctgctcagttccatgactaaagtctgcccttattaggtgcaacccaggagatcatgggttattctgtgaaaattcatcacgattacaagtgggggaaataaaacaaaagagaaaaattcctgtttccaacggttaatggggtcatctccatcaataaaagtatgcattcgggctctctagagaaacagaacaatagaagacaaatacagttttgagaggggatttatatggggaactggctcacattactatggaggctgagaagtcacaataggctgtctgcaagctggagaatcaggaaagccagtagcatggcccagtccaagtcttactgaacttatgtagtgatcttattttactgcttctccaggataatatgtccttcataccacatactgtatgcggagtatttattattacttgagtacacttccttggaaaggacatcaggggtttcataaaggcctcagaaccaggggtgctaacagtgtaactctcaatttgaggtcaaagtcctgatgtattagggttctccagagggacagaactgataggatatatgtatatatgaaagggaagtttttttggggggagaattggctcacgcgattacaaggcgaagtccgacaataggccatctgcaagctgtggaagagagaagctggtcattgctcagtctaaatttgaaagcctcgaacccagggaagctgaaagagcaggcttcagtctgtggccgaaggccccagagcccccgggaagccactggtacaagtcctagggtccaaaggctaaagaacctggagtgtgatgtctgaggacaggaggcgtgaaagcaagcatccagcatggaagaagaaagaaggcagccagaagcctcagcaagcaattgtcttcacttccacctgctttgttcttgctgcgctggcagccaatcgaatagtgcccacccacaatgggggtgggtcttcctttcccagtcaaccaactcaggtgtcaatctcctctagcaacaccctcacagatgcacccagaaacaataccggccacctaggcatcactcaatccaatcaagttgacacctaatatgaaccatcacacctgaaaacctgggggggcctctggtgcaagtcctggtatctggaggttgcagtgcctgagctcctgatgtctaagggcaggagaatatgggcattccagctccagaagaagaaatgtacctttcctctgtcattttgttctgtccaggcccttcgccaattggatggtgcctacccacatggggtgagggcggatctgtcttacttagttcactgattcaaatgccaatcctatctggaaacaccctcacagaggtacccagacataatgttttaccagctgtctcagtatgccttaatcctgtcaagttgatacctaaaattaaccatcagagtatacaatatttttttacgtttttgataattggaatcttaaatactatttgttttcaagttgtatactacatactgtaacataagtcatctttcaaatgaaatactttctgtaaatcttactgctttatgcatctgtatgttaaactgtgtaatacatttattatctcataaaatttattcactgcatggttcatttttttaatttatgcaatcttgtgttgtcaccaaacttaagtagttttaattgataatttcacaaagtagctatgaagtgcaataaggatgttggagatacctgagtttgttttttcttccccttttctgctgttccttttaattaaagatccatagtaattttttttccaaactaagccccctggcttgataattcacatttttgcataaaattgtatgttttttgctttttcttgaaatatgtgtacattacacataagttttattggcttacaatatcaaaatcggagtatagagctatgttgagtctcctaacttatgctgttaaaaagtacagtgccgttttgcaacgtcgagtcccggcctttctgcttcctatgggttggtagctttatatattatttagattcatttttcaacattgatattgcattgggcaccttccagtctttgctgatttcgcctgcagtgttctattaagtatttttgctaagagttgttcagtctgtgttctggtttctcttaaattctgaaaattccaaaatgatattctactgaaccaaggtgattacatgctttgaatggatctagtgacatatttgtttgtcaatttacggtacaaagagaaaatttaaactaaatttttttccccgatgtatgagattttaggaaatgcaccttttcagatttctcaattgacagttacaaacaatcagaatgttgaagaattataaccacagtcatcatctgcggttgttcccccttgctgccttgaggaataccctgcatttgtacatgtttctcctcacctcaaagttggaagtgtgtgaatgttttatcacaaactgaggtgatgaagccgagttctggtgaggaagcttgtatatcataaagaatacaaaactggaaataatatagtactgggtttaatctggactgggctattttacaacagctgacattgacaatttaacttcttctaggtttattcttcttattgataaaataggctaatatctaccctaatggcttttggaggatgaaaggagacattttttgcacctagtggatcttacactgcctaccacatggtaggtattcttaaaatggttgttttccctctctatccaacacagtcaactcatggaagagttgctcactaatattaccatgaactcattctggtagagattgtgccaaatgtacttgtaagctagtgtagcagtctaaggagcctgcttccagcttttatattgataacatttcttgctatcaactttctttggttctgaaatgtgagcctaagcctcaattctatgtacctatgtaggcttcagttcattttttccagcttaactggacacatgagtttttcttagatttagactgacccaggaaactgccttgaatgaccatatactatccagaggtgagactgtgtgggcaggatgtccacgtatccctgtttccaagtttatttgaaatgatagtgctccactgggagagttcataacgtttcctacctttatactctagacatcttcttcacagacactacacatgtgcgggggtgtgcaggttgcaccgtcaatgagagtttatgtaaaacacttaagagacttcagtgtactgggcagctcagctgattagagttatgttatgatcaaagacagttccttgttctcagtgtaggaggggcttaaaaacaatagcccttcctaccaaacctggttggaaacaagagcttgttttgaagctgtgtttgcatactcatctctttgacatttaggttctatatttgcatagtctgaggaatatgaagttagaacttcctattatcaaatcacctcttggagtgactacttaacagtttgctctacattgtgcaagtttagttcttatagaggagcagtggaggcattcttattcacctagatcttatttagtggatcaaagccaactgatttatgcggagctagacagacacagaaccttgaaagctgttgctgttgcttactcttagctgtttgatggtaattaatatgactgtcattgcatatcatgttgtctttgaattctgccactttaatctttaaaattatttttagctttactgggtgttttttttgtgtgtgtgtgcttcacattgttttctttggtcttacagacacttaacaaggcacatactgcctgtaattaaactgtgtgttgtttttcatttatgtatagaaattgatctctcctacttatcactaacacattttatatgcaccttaattttattgtgcatataaatccacatctgtgaatatatgccactcaacatctatgggaggaattatagctaaaatgtttcttattttcagcaatgattataattatttcttctatcttcttctgccttgctggccatttattctctctttgtcttttaaaattgtgttcatttacttttttatgcctgtagaattacatactaaggtggaatagtacatagtattagctctactagtatatctccaatctcatttccacttcttaatggactccagtcaatgtcttggtactaaaagcctgtcactactttcactctggcctttttatactttttcatttgcttgttttatggtatagttgctcttttttgtcaagtggtttataatatattcttccaagtgccaaagtttacaatctaaaacatctataacttcacttcataatgactttctactactatgtttctcatatattactttttggaatagctaacagaaatatgcatttgatataatttctattttttttgctaacccaacaaatactgaaacatgccccctatcaatttccttattacccctagagctatcttatataaaaagttagtatctgggaacaatggctgtaatggaaatttgagggataaatcatttttaaaatcgtattttataacagtttgacttctcctttcccacctaccagacagggcatcactcacactccagcactgctatgagtgtctgacatggtgtggtaggatatggactgctctttcatgcaagtgtatgctttgatttggtagcagtgggtttacactaaaagcatcatgacaactttagtgtggaccaagatgcgttctccttgctaattcttttagagccagtctgtgacagtcatcccagagcaatctgccatgatttggggtcattcttgttttggaagacctccagagagtttgttaattatgaggtttacatagaggttaagttcattcagtgtctggggtagttcaagaaacaatgattcatccagaatatatgtactacatgtgctgctaaatcctatggccatgcttacgctttaaccagtatatttttaaaagatgattattgccactactgaaatgacttccatatagtcaactgaaatgacttctatacagctatcaaatatttaatagtgcatgggaaggaaatctttttattcatgggtacttgttgaagctctgttcttcaagctgcatgttgacttatctgttaagtaagcctactgtcacaaagatgtcccatgtcagtggggtttgtccctgattcccactttatttaggggctatacattggacacatccagacccttgttaccactgcttcatttcagctcatcctaaattgcttaggtgtcctgcagtcaccccctcctcagtcattaacagaattaagctgcacaaagcatggcttcattgtcagtggattggatgtattacaaaagctcatggagttttttttattgttttctgccatttagtgatacatttggcttttaggaaatacaggtgaaccaattcaaaaagattattcaaatgctattgctcagtgtgtatactacgataaagcttttttaaattaacctctgaaataacagcttcagctttacacaaaactgtacacacatatttaagcgtaggtagtaagaagtttctggatgtcttttgatggaagatacttaagctacctttggattatacctaggtttacatacagggaatatatccaagcagattatgttgtctgagctttttccagctctgttttcattgtttacacagtatatataaagaagacagaagcaggaagcacaaacatctttttatgggcagagttgtctgcatggcaaagaggcttggactatatcccttagtagtagagtgccaaaaccatttaaacccttggatttttccaattcaaaataatttcttcatggaaaatagatgactaaggaaaaggagggaaaaaagtagtgagaggcagaatatctgatttaaatatgtacaatatgaaaaatcaggactttataatgtaaataatgtattatacaagtcaaattaatttttttccatatttctgcatttatgcctctaatgtggataagtttttatctttttaatccaaatacatgtatttgattaaaatgctccaatgtgtataatgctctgctttccttttggagaatatacctctttgcttgcaagttattagttgcaaacacctgcttaattttattatgtcttaaaatggtgaatatttctataaaatgttgtttttgttataaaattgtacattagtcaaagttttggtttctcttaatttagttttgcattttaggcttgccttaattacagagacgcaaaacgacatgttgggtttttataactgaatttttcatttttcttctggaaccaacatattttagtaattgctaaatactttgtaaaaccatgaaaaaattaaatgcctcacctgccctagactcgtaagagtaagaatagttggcataatgaagaatttttaatacagacttttttatacttgggttacttcagctttattagaaacacactgctataaacttaacaatttttgcaacacattcaagtaattgcttgacagaatcatagcttgtcttaacatgatacaaaaatgtgaaacattaataactatagtctcaattttgctccaatgcaaaacattctgtaagcctatttaatcagagcaagatcaactttcttgttcaagattttaaacatttatgttgtcctaattttactgccatatattatgtagctaggtttgtgagataaatgttgaaggtagaacactaccactgaaagcttcttaaaagcacaaataaaattttctaattattcgaggaaggagaaatgcttgcaaggcccgccatttgcagtcagcctcttccatttgattagaatcagtgaaatggacacaagctcttaatatgaaaaatattttctcctttctcccattctgacacatgcgcgatcccttttaaaatatagttgaacagtgaactaaacagatactttagaatagctgcatcaatttctccatctgttcattgttgattcaatggagctgagtaaatcagaagtgggatttaagaatcatgaaaagcactcagtcagcaaggacttactgagaacctccaatgtaaagaatactgaaccagtcaacatacggctaaaagagaattcaaaggcagactctggtctcagacgtatacttgatagatgattcagtatttcagaaaacatctcttcctataaaacattatttggtctctctccctcctctaagttgggcttcataaaaatacatgaaagatcttcatgtcctttagataacatcaatatagatgattaaccacttacggacccataagcgctgtcaactcactcaagttttcaatgattccatactgcctgtaattattaaatgcaaattcttctttcctatttcaacttacatagactataaactcaaatttgcatttcaatacagtatctctttagtattaagtaacgttattactactacttattgtgggtagtgtctacttattctgtgtccactttatccaagcctctgacacaggatgacaagcatacaggcagtcttcacttagtcacagcttttagttaagacagtgccatactatcagaaccatgtctaagctttgtactttgcattttattttgaaatgatttcagacctacgagttgcaacaatagtataaagtttccatatatccttcacgtagtttattggtttcagtttatatagccataatacatttatcaaaactagtaaattaacactggtatgatattgttaactaaaccaccgatattacttgtatactagtggttcttctactaatatgctttttcttttccagaaaattgcataccatccagatccaatgtgggatatccagtctgggatactatttcgcatttagttttcatatcttcttaatctctcccaatctgtgaaagcttcttgagtgtcccttgtctttcatgatcttaacacttctgatgactactaattagatttttttttcaaatgtcccttcgtttgtgtttgtcttacaattagattgaggttacagattttgtggaaaaataccattgaggtgtcatatcagggatgataccaacatgactgacttttggcgatgttgaccttgaccatttggttaagaaagtgtctgccaggtttctctagtgtaaagtgtctatttctctctttctacactttaatcattagaagaaagttactgagtacagcctacactcgaggagtatggtggtagtggttaaatatcatctctggaaacaggtggtgacaatttgtggactcttgttaaaattatgatagtaaatatttcaggagtacaaatatctctaactattcatgacaaattttagcactgctccatagatcttgcttgtagctgttattactgtggtgttcctagaaatagtgatgcctcagtagcaataagaaaacaaggtgttgctttacaaatagcattctacaataaaagaaaacgagctcactggagaaatggctgattctagggctgagtcaggaaatacacaagatgaacctggagcatcttgcattgccagaaggtaaataaatgctataaaaacaaaataacaacaaaaacaacaggagcttgtcaaaaggacacagaaacaagcccccaaaatctgtcagtagccaaagctagaaaaatacaatgaccaaagtaaatagtgacagtattggattataatgtcaagagtaaaataactgagtctatactaccattctgataaaactaaatgactgaataaatgcagaagagaaaaatattgcttatggaattccagttattaaaagtagaaacagtgagggaaataggaaaatcactgagtcacaaatgaattctagtatccgattttatatctgtcaaaagtgtatttcacataattttatcaaatatataaaccactttgcatcctactcttttacttagcaattaatccaaatatcttatgccatatatcttataataaaattaacattgtagaaaatttggaaaatgaacagaattaagaaaaatacatgcattcaggccaaaaatgaataaggctctttggattttagtatatttattcagtttttaatttgcatttttacactgttagcatttgtatatttatacatattttgtagaaattttgaataatactgcagatgctgtcatttagcaatttcatgaacttttttctaagtagtattaagtattttttaaaatactaaattactgggtcctcttatgtagactatccatatacatatctaaaagtctcccttagacattatatatagaatgctataataaatacacatatataaatctttgcctacatgttattttggctaaaggtaagttcttagcaagatgaagaggtcaaataatagaaacacttaaagctcttgggcacataaacatggcttctcaatactatcatgaaactaatacaatttaattaactactctattattttgggcatttaagtaaattccctgcattttacactatcagcgatggtatctgcatctttacctgaattattgactgtgaattatcaactcttttaagctgctaatacatattgataaattggcttccaaaatagattgcaccaggggaaattcccaccatcaataattgtttttgtctcatatacccttgaaatgttaactataatcattttgtttaaatccttgctaattttacatatgatcaaggtatttaactgcttttctttgattacttagtgagagagattgaacatacaacattaaaaatggacctgttctttgaaaatgttatattacatgaatatggatataaatttatctttcacgtaatttagcccatatttctaatagtcaattagtcatcactagatacttctattaattcaacataacttcaaaatggactcttattcataaaaatttttaatataaatatatattttttgatggcaggcagtcagaacctagcaaataaaactactttgaaaaggactgtgaaaattaacctgaaaaaatagcctatatgatatttttaaaaaatatgtttttatatttatactcattttagttcttttaattttatggagttcaaattaccatgtaaatattattaaaacatccagattagttattttacattcttttaagatataataaaaatttgaaataatttctagtaattataacattttgcagtcccaacagggaaagtcatcacaatttcaatgagatgctctagagtagcttttaaaatataaactatgtgtatatcagtaacctgttagtaggttatgagtatgtaacttggaatgccattaatataatattttgatcattaacctgttgaaattaagctagtaggtctctataatttaatgaaataatacatacttggatatgttccgctgtgttgtctgccaaggaaaaaaaaagacacattaaaatctttatgattgaaacacctaaagaggccagaagggactttaagttctctcacagaagtgcaagaagatacaaaaatgaaggtggaatgtacatttcattaggttaatgtctcttatcagcaaaagtagaaaagccatccatctgttgaactagaaaacatgtttgccaagcactttattccttttaactttaattcttttgtattttaagaaaaatgaagtctatacatttgctattattacttttagattctactaaagttaagcaactttattcaacttcattgaatttcctctcaatctctttttaattagtattactacttaggtataaaaaggtagaaatagaacttgattggttatatggatattctttttattttttcattgattcatttcttcatttgaaaaactgaagtggcagattctgtcagggactgcattgaatccttgtacaaatctgaagataagtcatggtgcttgccatcaagttgttctcactgcagtggcaggaagaattaaggtgaccacagccttgagaagtgctttaagaaaacaaatccatgagggggattatctatgtccttgatgaaatatgagtaagaggatagtccacatcattggagtaatcgaaggcatcctttggtttctggtttagaatcttatttggatagcaatcgtagcagtctcctaattgcgagttagatacacatgaaagcaaacgaaaactatgaccaatcatgaatctcacaaaattcagtgaatgattggattgatctgggtgggggggtgttttgacaaattggtattgacagctaacacatgtataagcttcctatatgacaggtactgttctaagtgttttatctataatatgaggtttaatccttacaacaaacttgtgaagtagttagaattttccccattttacaagtggttgaggcaaatttgataaattctactggaatcatacattcggattccagggtctgtgttctcacaatctttatgttctgttactttatagaagcatgggggctaacaaattttaatcaaaaaactgaaccagcagtatgcactgggttgtactccttttttcttgaagatagtccaggaaggatgtaggaagaaaactttagcctttctctcactatggttcttggctgaaatctgagactttgataaagtgaaacatattctttaaagttacaactacaggtatatgatcatatatgtcatatgatatgaaaggtgcttcatatctgtacagtttaatgcactttgcatgctgtgtcagccactcatataatacaatggaccaccacgccctttcaactttcatcaatgtggcttctgcagtctaggacagaaaaagaaaaaaccagaattgataatgtaaagaacatgaaagctagagtctagttgctcaaaacaagcatatgataaatgaagacaaaacaatctaaatttgtttagatcaatgatgaatgacattcttacatctgaatatgtctgtttcttaaggatggatggctaaaggaaactagaaatgctatagtagaattaaaaggaaatattagaattgatagaaaatcaaacttccagaatacacaaatgtgcagcaaaatgatgcaaactctaataaaggaatccaaagaagaaagaaaaacttaacacaggcaatatttagtataaaaatcaaatgatcaaaaacaattgttagactggcttcttacttggtttgcgatattaaacttgagaaaacaatgtagtaagtatctagatattttaaaggggaaaatagaattaagcaaggattttctataactgaacagtcatccatgtgtgaaggcagcagaaaatattctcatgtggaagagctcaaagtataccagtatctaattacagaactaagaaaatagaaacaattatcaaaacattttttctttacatacaactctttattgtgtaaaatactttgaatagaatagttgagcagagatacataaagtgttccaatttttatctaaaaatagaaacatactgatatctgcttgaatgtaattaatgcatgttaaatatgtgcttttataaaacaccctagtaaattaaaacctcaaaatcactgaaaaggtagacacaaaccaagcatagtttattgaggttcataacatatgcaacaaagagtgagcaaagcgagaaacacgaaaccccaaagacataaaataggggaacagaaaaccagccacaactcttatgagagaaaattcaaatggttccaagttttacattaagttaaggatattcaattaaaaataaagttcaactatttttgagatagctgggaagcaaaattactgatataagttaaaaattaaagattaggcaataatttattaagcaataagaataaagtcaggttgatcatattaatttcagacaaagttgaatttaaggaaagtcagtgcattaaagtgtcttataaaaatacagtggtcatgaatttttaaatttgtaataaagataatcacaaaaggaagttaggagatgatttgtaatttgaagaaaaattaatcaacaatttaggaaaacaaaatccatttaatatatagcagagacctgttagataattttactgaggccctgtgatctttatttgaaagattaaaaccccccaaaaaggttaaaattttcagtagctcagtaagtatgatttttttcccgtccttccagcttttttttttttttgtagttgttggtaatacaatcttgatagtttatatattcactttgatgtcaaacccagctaggatactatgtttctcagccggtgttgcagctggtgtgaacacagaactgggttctgaccagagatgtaaatgaagtagtgtgggactccctaaaggcagcattgtgggaagattccacaaggcagctggctcagttcgatgataggacctgtttgccgtttcctcttgctccttccagctatctagaacacagatatatagctggaaattcagtagtggtttcagaccaggaggtcatgttgataagaaagccatggactagaatagcagagaaaatgaagaaatttgggttgctgataacaatggagttatcatttttgatcttgattaactacctttagatttgttttatgagagagaagaaaatcctcatcttgtttaactgttattttgagttttctgtctattgcagttaaatatcatttctaaccaagactgagataaagggttttagtcttaatgttgaatccatttatatactatccaaaaacaatgaaatatttcaagtatccatatcatatttttttaaaaatgaatctaacctagatgtgagagagattagtacgtattaaatttctaaaatgcaatggactgagtggaaccctgagtaatacctagaaactattaaataatacattctaaaacaaagcttcaaaaagttataactatttagcaaaaaatggcaaaaatgaaaaacattaagtaattatcaggcaggaaaggtgacattatacctgcactaatgaccacaagcttctaggctcaagatcctctacctatcttgacccactagaggtgtcaggggttcaagacaccctacccttgtagcctcctggggagggctgtggaccacctttaattacacacatttggccacattattaggagtgattcatagcctgtggcatagtaattccacttctagatacgtgagaataatccaaaatgctgactgggatttatgcaagagttcaaacttagcaaaacaaaggaaataacaaaaatgcctagcaatggaaaaatagttaaattatggaaagcagatagctagccaatcattataggataatgtcttggtctatttgggctgctatagcaaactaccatagactgggttgtttgtaaataacaaacttatttctaacaattctaggggctgggcagtctcagactgagttaccggtgtttaatgagggcctgctttctgcttcacaacagtactttctggctgtgtcttcacatggtgaaggggatgaggagtctgtcctttgcctgttttataaagacactaatcctttataaaagacaagaaatgggtacgggctgtgcgtggtggctcatacttgcagcacttcgagatgccaaggtgggtggagcacctcaggtcgggagtttgagagcagcctggcaaacatgttaaaactctgtctccactaaaatataaaaaactagtctggcatggtggtttgcacctgcagtcccagctactcgggatgctgaggcacgagaattgcttgaacctgggaggaggaggttgcagtaagccaaaattgcaccactgcactccagcctgggtggcagagtgagactccatcttgaaaaatcaaggcagcgggttcaaaaaaaaaaaagagacctagtatttgatagcacaataggttgttgactgtagtcaaaatacatttaaaaataactaaaagagtataagtggatcgcttataaaacaaagaataagtgtttaaggaattgcatacctcattttccatgatgcgattattatgccttgaatgcctgtatcaaaatatctcactgaaatagaaaaggttcccttgtcccctcgaagggtgtgtgacaaggggagtggctggccttttcagtgccccgctgctcaaacctctaggggaacatacagacgggcaggttgtggggctccgaccctaaggcagtgactagtggtggatgtttacagctcctgaagccccagtgggtgtgtgttaaatggtgctcttttagtttgctgtctataggcatttagtttgctgtccataggcagcttgtattaaccagctcaactggaccctctaccttgtcataaggacagagggctgtctgtttcccgggttcttgccttggtatactagaagaatcggaccacaggtggacttggagaatgagtgcaaggttttattgagtagaagtagctctcagcagataggggagccagaagtgagatggttttcccctggagtcaggccacagcggccaggctctcctccaaccaccctggccaaactccatgttgttctgccagtcaatggcctgcttgtgtgccagtgcctgccagtgtgttccccaggtgctctccatgtccagcctcttatatcttcctccacccatccacacctcttgacgtccagccctttttttcttcttcaaccaatctgcttttctggagattcaggtgcttgtatcttcctccaccaatctgcttctcttaaccagccacttgtgtgtctgcctgctaaggtcttgggtttaacaggcccagggtgggggcgtggcgggtcagggtggtcttgaaaaatgcaacatttgggcatgaaggcaggagtgcctgtcctcacctaggtccataggcacaggcccaagggtgaagccctagccagggactcgcctttctctacccagcacttccctgcccccctcccatatcctcatgtatcccatgaatattaaaaagcccttgtgaactaatcattctcaaatgttctacctcctaatttcatcacattgtgggttaggacttgaacatgtaaatctggtcagggggacacaaatgtttagaccataaaaattttaatgaaagaatttaactgtttttgtcagatttgtcaaagatcagatggttgtagatgtgtggtattatttctgagggctctgttctgttccattggtctatatctctgttttggtaccagtaccatgctgttttggttactgtagccttgtagtatagtttgaagtcaggtagtgtgatgcctccagctttgttcttttagcttaggagtcttggcaatgcaggctcttttttggttccatatgaactttaaagtagttttttccaattctgtgaagaaagtcattggtagctcgatggggatggcattgaatctataaattaccttgggcagtgaggccattttcacgatattgattcttcctatccatgagcatggaatgttcttccatttgtttgtgtcctcttttatttcgttgaacagtggtttgtaattctccttgaagaggtccttcacatcccttgtaagttggattcctgggtattttattctctttgaagcaattgtgaatgggagttcactcataatttgggtttaaaaacaagaaatggggaaaggatactctatttaataaatggtgctgggaaaactggctagccatatgtagaaagctgaaactggatcccttcctaacaccttatacaaaaattaattcaagatagattaaagacttaaatgttagacctaaaaccctaaaaaccctagaagaaaacctaggaaataccattcaggtcataggcatgggcaaggacttcatgtctaaaacaccaaaagcaatgacaacaaaagccaaaattgacaaatgggatctcattaaactaaagagcttctgcacagcaaaataaactaccatcagagtaaacaggcaacctaacagaatgggagaaaggttttgctatctacccatctgacaaagggctaatatcccaaatctacaaagaacttaaacaaatttacaagaaaaaatcaaccccatcaaaaagtgggcgaaggatatgaacagacgcttctcaaaagaagacatttatgcagccaaaagacacatgaaaaaatgctcatcatcactggccgtcggagaaatgcaaatcaaaaccacaatgagatactatctcatgccagttagaatggcaatcattaaaaagtcaggaaacaggtgctggaaggaacacttttacactgttggtgtgagtgtaaagtagttcaaccattgtggaagacagtgtggtgattcctcaaggatctagaactagaaatatcatttgacccagccatcccattactgggtatacccaaaggattataaatcatgctgctataaagacacaggcacacgtatgtttattgcggcactattcacaatagcaaagacttggaaccaacccaaatgtccatcaatgatagactggattaagaaaatgtggcacatatacaccatggaatactatgcagccataaaaaatgaagagttcatgtcctttgtagggacatggatgaagctggaaaccatcattctcagcaaactatctcaaggacagaaaaccaaacactgcatattctcactcataggtgggaattgaacaatgagaacacctggacacaggaaggggaacatcacacaccggggcctgttgtgggctgggggtagtggggagggatagcattaggagatatacctaatgtaaatgatgagttaatgggtgcagcacaccaacatggcacatgtgtacatatataacaaacctgcacattgtgcacatgtaccctagaacttaaagtataataataataataaaaagaatttaactgtattgattattctgggacaattttaaaatcaatataaaaaatagatgtaatcaataaaactttcaaaaagaaacaaatgtattaaaggtgttctctatttagtgggaaaatagccaattcttttctttctatgatttttttcatttttccagttttctgcatgcatgagttcttattttcatagaaaaattagattttttaaagaatagaactgcatctaaaaaaattaaaacagatccataaaaacatgttcagtaaaatgttatataaatatgaagtaatcagggaattctttgaactaagtttatgaaccatatgctagtaagcatatgctgtcagaatcaggagagaattgttttgctatattctttcaatgtgttaagagggaagacgatatggttttacatatagttgctcctgaggttgaaaagcatttcattgaaggtttaaaagtccactttcttatacatagaaaagatttgtgtgatgcagagaagtttcccaatgtctcattatagaccaaaagaaccagactcagaaaatattaagtcaaaaggcaaatggatgataaaccctacatcacaaaaatcttttctatgtatgagaaagtggacttttttaatgatatgatagtttacctagaaaaccctaaagacttccccaaaaagctcctggaactgatagataaattgagcaaagtttctggttacaaaattaattaatgtatacaaatcagtagctcttctatacaccaatagcgaccaagctgagaatcaaatcaagaactcaacccttttacaatagctgcaaaaatatatatatacttgggaagatacccaaccaaggaggtgaaagacctctataaggaaaactacaaaacactgctgaaagaaatcatagatgacataaacaaatggaaacacatcccatgctcatggatgggtagaatcaatattgcgaaaatgaccacactgccaaaagcaatctacaaattcaatacaatttccaccaaaataccaccattgttcatcatagaactacaaaaacaatcctaaaattcatataaaaccaaaaaagagcttgtgtagccaaagcatgactaagcaaaaagagcaaatctggaggcatcgcattacctgatttgaaactatactataaggccatagtcaccaaaacaacatagtactagcataaaaataggcacatagacgaatggaaaagaataaagaacccagaaataaaccgaatacttacagccaactcatcttaaacaaagcaaacaaaaacctaaagggggcaaaggataccttattcaacaaattgtgttgggataattggcaagccatatgtaggagaataaaactgaatccccatctctcaccttatacaaaaatcatctcaagatggatcaagaacttaaatctaagatctgaaactataacagttctagaagataacattggaaaatcccttctagacattggcttaggcaagggtttcatgaccaagaatccaaagcaaatgcaataaaaacaaagataaatagttgggacctaataaaactacatagcttttgcacagcaaaaggaatgatcagaagagtaaacagacaacccacagagtgggagaaaatctttataatctatacatcttacaaaggactaatatccagaatctacaaggaaatcaaattagcaagaaaaaaaacaattccatcaaaaaatgggctaagaaaatgaatagacaactctcaaaagaagatatactaatggccaacaaacatatgaaaaaatgctcaacatcagtaatgatcagggaaatgcaaatcaaaaccacaaggtagtaaccgtactcctgcaagaatggccataatcaaaaaatcaaaaaataatagatattagcgtggatgtgattagaagggaacacttctacactgctggtggggaatgtaaactaatacaaccactatggaaaaaagtgtggggattccttaaagaactaaaagtagaactaccatttgatccagcaatcccactactgggtgtctacccagaagaaaagaagtcgttatacaaaaaatacttgcacacacatgtttatagcagcacaattcgcaactgcaaaaatatggaaccagcccaaatgcccatcaatcaacaagtgaataaactggtgttgtgtgtgtgtgtgtatatatatgtgtgtgtgtgtatatatatatacacacatactagtgtttgtgtgtgtgtgtgtatatatatatgattgtggtttgaataaaatcttatattcagtctcaatttttctgaaaaatttctttgaaattaatcaaacatggaaaaccccacaaaaacctaaatggaaggttttcttgttttagaaacgcactgggggcaaaacagctggagtgtgtttaatggtctcccttatgagcagggtgtgtatagcatattatgctgtttgcagagtcctgtgaactaaactaaatgggacttctggttggatttgtaagtcacctaggtttagagtactagaagctgtgctactagaaggaataccccaatagcaagggaaaggagagctatagtataagtttttcttgtccatatgtattagaatattttttattagctaattttttaaattttgtttatttatttatttttgagacagtgtcttactctgtcgcccaggctggagtgcagtggcacgatctcagctccctgcaacctccacgtcccaggttcaagcgattctcctgcctgagcctcccaagcagctgggattacaggcacccaccaccacgcccagctaattttttacttgttgttgtatttttagtagagatggggtttcactattttggccaggctggtctcaaactcctgacctcaggtgatctgcctgcctcggcctcccaaagtgctgagattataggtgggagccacggcaccaggcctgttttattttttatctagtattttgttattttgatacctctctcatctgggtcccagcatgtgaatatctcttagctgaagggaggtttgctatactagaatataaaagtgataggataaaaattttgggttttttgaaattcaaaaagttctaagtggaaggagtaggggctggaagaatgtacaactggaaatattcctatgttcatagcagaaacagttgatggactaggttagggtgtggcgggggcagagaatcagatagaattcaaaagcaggttatcttagtgggtctcatttgcaggattcaaggggtcctagagtaagatattagagatttgagaacagaggtgatttgttgtcccagtttttggccaggcttgaaaagtggtaagatctcactctgtactgggaaaggcagggcagcacaggctaggaaggatggcaggccattttgaggcagtagtgacctaaaacagcctcatagtgtttagggtcaagcaaaagcatcagaatttttttttttggttaccctaaaaggagctccaaactgctggaaacacacagtgcttagaaaggacttaagtttgggagtgaaagacaatgataccatgaccttagcggtagacactgaagtctatacagggtaacatacatttcaacaaacactaccatggtccagcgtggacaagcatccatctcttcagtggcattacataaatcctaagaaccgttcaaacttaaaagttagatcatcttcaattaaagtgatattacttagttgggttagttgcagctttgagacttgtaactcataactgaaagacataattcaccaataatcctgataaacagagcttttgacagtttgtgtttctgattattctccaatacattttccagattgagtttccttaaacaatgatgtgtagacataaggaaggactcatgaaaacattgaaatagattctagtaagtcttagaccattaaaagtaaaattttacaataaacgtgagcaaagctttaatagtacaaaattgtaaaagatctagagcagaagtatatataaaataggcttaaaaataatgcaatagttttataaatatagcatactagtgttataaattccccattaaacatcaaattaatagaaattcaaaatcctttcgtctggtgtgattctatacaagcaaaaggattttctttcatatctaatcattcaagttgtgcttatttggcctcctaaatatttttccataattgccttttcttcatcacttctacagctataaatacagacatcatgctaaatagtggagacctaccatgtatgtggctcctctgtgaaggaaatgactgtacagtgtgacaaaggttttgctggagaaatacaaagtactacagtggaggtgatatcgtttggatatttgtcccctacaaatcttaggttaaaaattgatccccagtgttgtagttgaggcctgatgagaggcgttgggtcacaggagcagatcagtcaagaatggcttggtgcggtccttgtggtaatgagttttgctctattcgttcccacgagatctgattgttaagaaaaccctcgtacctcctctcatctttctccttgcctctctcaccgtgtgatatttgttccccttccaccaagattaaaagcttcctgaagtcctgaccggagcagatactggtgccatgcttcttctatggcctgcagaactgtgagatacataaaccccttttctttatgaattacccaccctcaggtattcctttagagtgatgtaaaagggactaacatgggacagatctaacttatcctgtagtgttgagaggaggtgccagctgggcttcctgggtcaagtagggtctcagaaagctgtgaaacttactcatttcctgcatcaggacttctttcggtcctggatgaataagattgaagatatatgcttaaaatattcctaacaccggggtttgtgcatgtgttttcttccccaagaaagctataaacagcacaaattttgctctaagtttccctgtgtcctctctccctctctcccttccccctcccctgaaactaaagtaaaaagaatgctaactgcccatttttctgtgaccagcggaccttatctatactcccaattccaattccttgtaaacatactttgtaaagtcctgtaagatcctgtctcctttgccatgccgctacaaggccataaagtagataaaacctaagttgcaattccagtcttcctcaaatctaagacatgtcacaaaataatttactgcctttgtttcttgctcctgtaacaagcttcctgcctcacgtatctcccaccttaaaatgtttaaaaggcgaatacccaaactagcagtggctaccctttcgggaccccttccacactgtggaagctttgtactttcactctgctcaataaaacttacagctttttctctctctcagttggtgtctctatcgctcgccgcagtcagccgccacaccaattctttggcgtcgctaagcaagaaccttaggcgttacagtgtcagggatgaaagccctaaagaaaataacttgagactgagaggaagttttctgggtaaaaggtctttggagtgaggatggaaatggggtgagaacattaagaataggaaacagcatgtggatggtatctgagaaaagggagaataaggagggctgcctgaaaatagctaatgtggtggagccaagagtgcgaggggagtcacgtgatacaaggctggagaggatccagaggatcgaacaagttaaggatttgttctaaaggcaaccatcaaagggccttaagcagcagattgacataaactgtacttttaaagaaagctctacctgttgtgaagaagatggagtggagaagaggagcgaggactggactgggcaagatgggttgaagttaaaaagccgctccatgtgagggatcctggtgaccagggctaaggcaactccacacacacacacacacacacacacacacacacacacacacacacacacgtatgtatacatatacataaatgcttatattcatgtaccaacgtttgatttcaagtatccattaaacagataaaatgaccatatagtaaacatttttcaaaaacaaaaatacgttttgcagttaatctaaccatgtaggtaagaaataccttagggaaatgtctttcaaaagctgtcttttgaaagcttatgtttcaagatgctcatttagggtcacggattagagacaagatgagatttttagttttggttaagagactatgattaattctatttccaactgtcctaggtgtttgctgaaatgtcagcaaggtgtcacctgtcccactaattgaaatggcaggacgtttcctgcaagaaatatgaaccacggtagtacactgtgtgaaaaatccttagtgatgtggaaaaagtctgtcactgtgtcaaggccttcagtgtcagcatggaatatgcatatcatgaatttgcaggtggaagaatcggccacattatctgcctcagtacctggtgattgaggagagtctgagctgctgcagtaggaattgcaagatgaaggatgaatgctggggtcattttgtaaattagtggacttcaagtaattatcttttgaattgagcatagtttacacaaagagaagataccatggttgaatacattgtgaaaaaaattgctatgcctctagttaggtcaagataaagaaaaggagagcaattagtaattggaaaaaaatcaccaaaaaagttgaatgtactccctgttgccacagaaaaacatttggaccataatagtcaagtctgaattgttaatctataatgtgtacacaatactaaattgaggggaaatgacattaagattataattaatgtgcattttctggcaggacaggtggaggaggaaaaattatggacatttatagtttggtaataactggttattagaataattaaaatctgaggcctatatcaatcagtaatacgtatgaagcatccacagaacgccttgtcaagctcctgtggagatccttatttttcccatccagaaagaccttggcagtcagataccatttgacacctatcttgcctctagaactacacgtttgaagtattctcggaactagctgaactgtaaagtatattaacactatgtatataattttactttctctattacttatatagctgtctcatataaggttgtctgcaaatataagaccacacccctcagaagaaaagtgcaatttgaagttagctttatccaacttcacatccatttaatatgctgacatatgtcttttttagaattatatacctctgttgtgtcttcctgcaagcaaattaagatgcaagctacaatggcttgttacatttctaggtcttatattttttcctgaccccatattggaggcaagttttctcacctccactcatttctcatttcgaagtcataggtttaacctccattttcatgcctaacatccgttttgacattaggttatatctttaggaacctgatgttattgattaaaatacttcagcattcaatatttttgttcttaacgtcatttaacttataataatctagttcctgaagtcggtcatgtcccaacaatctaaattacatcttaagttcagttccccaaatattagtatttttgataacagttctgtagcacaatacgttcaagattggtatcatctcttagtgtgaccagaagtttcagctacggggtgctggattctaccaagtaagaaccaactttctgctgtttatctactttccagaagctccacaaatttaaatgttcctggataacaccatttcctgctactatctagtgaactctattaactgctgtgagtaaaagtaaagaataccctaccgaggcaaactatagaaaattcagcctcaaatcataggctacatgttgaccaagaaggctacactgtccaggtagtgtacctgcatcatggtgaggccaccatctacctagttcccagtccctggagcaaaagttcttgtgtgtgtatgtgtcagtccgttttgttttgctatgaaggaatacctgaggctgggtaatttatgaagaaaagaggtttatttgacttatggttctgtaggctgtacaagaagcatggcaccagcatcagcttctggtaagagtctcaaggagcttccactcatggtaaaggcaaaggggagtaggcatcacatggtgggagaggaaggaagagagaaaggaggggaggtgtttggctctctaatagccagatctgaaaactgagtgagaacgcatgcaatcctgtgagaatggcatgaagccattcataagggatctgcacccataatgcaaacacctcccaccaggccccacctccaacactggggatcacattttgatatgagatttggaggggacaaacattcaaactatttcagggcatattgcggagttcatttgacttgaagagtttgttgttgcagcataactttcaaaatgaacacaaaaaattactaatttgtctattgattttaggattgtgaaagaaaaatattgaagggtgaataacagtttgataagtgaactaagagagggtggtatatttcaggcagaagaaataaacattaaggaaattacagaaaaatgcaaacagtgtgtttagagattaggaactattttggaattattctcttttctactttcccattatactgtatatctctaccataacattttttccatggttacaaattaattttgtatatgtccatttcttaaactttgagttcctgtgagcaagaacatattttttcatcattttgtcctccatgtaatctatcttgtgcaaaatagctatctaatgttcataagtttaagttacgtagaattaaagaacttattttctttgaatgtttaattcccttattgaaaacattgtcatttagatacacactcccagaaaaagtatctattcttccctgagaaagacatacaggactgccatgggctttgtgtaaacaaagtgatttcaagctgacaagacacatttagatttctgagtaattataaaaatagccctagataaagtccttataaatgcttataacattaacagctctgtgatatgcataaatacacgtaagtaaaatgccacaggttatagtccttaaaaacgcttcgtgcttacagttcacatagcagtatgcataaatacacgcattataatatcacaggatgcaattgttagaaactgcttgtaacattaacaggtcttaccgtgaagtgcatgtaataaaaaatactcaacagaagtattcatggccaagacatgggcttaaccacaaataatttttcaattgggagcaacagattcaaagcattcagtggtgctgtaaatgtttgcatgcttcttttcaactaaaccagacattatgtgacctgaaacaaaattttagtaacttcaagtggtttcgaaagagttaagtttgtttttttatgaaaagctttctgtctcccctctgcctttgaagctcttctacagaatgtgaatgcatatgtgtgtaaatatcctcattgtttccaatgccagagaagatcttcacagtgattctatttatccaaggaactgaaatttatcaggtcttagatctttgtaaacaggactttacaactcaagatatactgaaagattgacattggagccttccttcaggaccaaagctagctgtcaaattccaaggacatctataggataagcagcattgcccttcctgtgtaggtggccaccagcgtgtgatttcagctggtttgagatggtttctagcaagaatccctcacactagttcctgtgtttggttggtatttctcttaattaagagtgattttcttattatatttatctttataattcaaatatttctataacattcattaaaaacacacaagttatcgtaaaataatttctagaacagaagcgaataatattctatgataggaaaattgaggaataaagtgccaaaactggagtttgaacagtactgaaaatattttagaccagtgatcagttagaaaccagatctgtttactacaaggaaaagggtaacaggataaaaccttattagcagtggtaacagggaaagattcagatgggttgttcagtgtctgccctcttttatagagccccctggtaatagtcagcaaataatggtcacgccataggaacctggcagtaaacaaagggcagtcctaaaaatgtagagtctagccttccctttgatgaagatgaccgccagtatgatacactcaggtcaatgatattacattttaccttccccagaagacaagcctgataatgagatgcccaccataaggaatttctgatgacttctcatagattacagaaagaaattcaaaattcagcatgacaaacgagacccttcatatttgatgttgcactttcctttaagatttacctttaacatctgttctctgtctagctccaagcatattgctaagcagaggtggtattcttcacacttcccttttgcacttgaactttctcttgccgggaatgttctctatttcaccagaggagctcctgcttagccttcaagacacacttcattgttcttttcagcttcctcagtggaccagttatagggcacttcagaatgtttcaattttgtgtttagacgcctcaaggagccattagtcccttagctccatgaggaaatggattgtctcttataggagcctcatgtgcaactataaattaacacagaatctgatatgcttatcaccatacaactctacaaaaacaatgttcacattgaaagttttttttctgttttaataagtacgccagatttaatggaagtattttcttttgtttcctttttctctagtatatttagattgcaattctaaaattgagactggatgacacctgaaaatgtgaaatgaataaataatatgagaacttttaaaattttctgatctttctgacaaagctcaagttttgttcggagtaactcatatttttagaactatttctaaatgtttaccttaacatgtaattttccgttgtgagttttaaataatgccacataaaatgtaaccagttataattttattaaaaatttggagaccaagctactgaaaaaaagttgatgacattaaagaactttcataaagtatgtaatttagttttgtgtgtgaagcctttagtaattggacaactggctgccttgtgaaaatgcattattatcactaatatcttcattatttgtagtataaccatatgcctcatgattctttgtgacagcctgttgttattttgtgagaaagatgattaggctattatttgatttcagcacatgtatggtttatcagaaagtctgcacaatgtgaataggcagtttttacaccctcaaagctccaattttgtaataattatataaatagtattctcctcaaagtgaggctcttcttgttaatgtccagtgtacagaacttggcttgagtatgggcatgaaacaaagcaattgcgcatctgcaaatacaggacatgtactaccatgtttgtgtcagtttcttacaaaggctaagaatggttgtggtggtgggggcgggaggaaggtaatgagtgggtgggatttagctgaaggattagaaaagaagcagctcattgatttattcaacacatacctctttgattcctagtaccgaactgtggtttaatgaattgtaaggtatagcataaaaacaacggttagattagtggttttgcccttgagaaatgtttcccgcctgtagtcccagctactcgcgaggcggaggcaggggaatcgcttgagcccgggaggcgcaggtcgcagtgagccatcgcgccactgcactccagcctggcgacagtgcaagactccgtctcaaaaaaaaaaaaaaaaaaaaaaaaaaaaagaaacagaaatgtttccacctgatgatgagctaaacaattagatattatggcatcatagagaaataagaaatatccagaaatcttatgctatattatgctgcatattgatatttataccacatagccaagtttttcctttttaaggaattcccccatcctagaagatatttgtagttattcatatatgaagattcctcacttttgaaactttaggtctgtattccatttggatttatttcattttctttacctccacaactggtaggatttctgtctaccatccatttaggttctcattttgactatccaacttcttgaaagattcagcacttttcagcctctgagctctgctctgttccaaataaactttgattcaccttcgcagttctgatttctctcatccctgggacttctttttcttgcatgaagtcctgggagcaagcttctcacgtggttttgttccttcgttgtggggtggtcgggggagtgtggtcggttctagataatttcctaaacaaaaacattaaattgcttttccaggtgccaaaagaaaaaaaaaaaaactctagcattacgtatggcaatcaaaatcttcctcattatgatcctgtgacctactattccaaatatttgcacttttcctcagaaaatattaaataaccattttcaaacacattcttcctttccaccacagtcacttctagttatttgtgttagttacgttctataaaattgttaagaaaaataaattagcaaatactgaaccatttgctgccaggggaaacacggggtcagattttcatgaacaaatcaatacataactttgatgtttgtttctatttaaagacacattatttgatatatattgttgattcattaacagtaagcttataatcacattataatatgtatctgaatgaagtttatttaacaacatgttttctttgtaaggaatgtgacagccttgttatgctagaaactacttcaagctgtgcttgggggttattttaaacaccaacaaaaatcacaaaagagaaaaatgcaaatataaatatgtcactgagaaaaggatacttgtttatagtaggagagctgcgataagaaggcacagtgtcacctgctttgacctcagctgggaacgttcttgtcaggcaactcgaatttttctccgttctgcacaggtctgtgaatgactgtgaaagcactggtagtactgatttggggttacaaataaactttaacaagcaggtgagtttgcaaatacagaatccacaaataatgaggattctgtccttgcttctagttgaggtaaaagcaaaaagttgcaaatggattaaaaaagactatttttggcagaagttgtagcattcttatctattgtagtattcaaacatatattctcatttttaaaagaatgataatggttaaatatatactgagttctcagtacgtatcaggtcccgtgctaaatgctttatgtgtgttaactcgagcctaatccaaagtttgaattgtggaggaaagttgtattatattgtgttagcttggatgcgtacaggaaagaactaataatctgtgagccaagcagccaccgtaaagttgagctcagatggaacaggtgacaatgataggattaataggaaataagtgtgagggcagagtgagtgcaatctcaaacagtgtgtattagaagacgtttacaaataacctgttaacaaagccacatgtttgcatgttttataccagaaccttgaatgtgggaaaaaatgttaccgtctttgcaaaagaattacatgcacttaaatttttgagaaaagattggctccaagaagttgacataactatattagctaaagctcagcttccaaattgtaatcttttgtaggttttttaaaaatgttttatttgcacattttcctccattttctcaggaactccatgtgaaatgacattctttcccaccttggaggaaggggtgaaatgtgaggcattcatttacatggaacaaaatgagtgtaaaacttttaattatatcttggctagaatttgcctgagaatttaaagtgtaggcctggccttatgcccctcacctagcattcaagggaaatgaaataattaaaagaattaccaatgcttttaaagcatgaccttttacagatgactcacagtagatgattttatatatatcaactagatacagtcaaatagtcaagaacattttgcctagaaactcacttgttttttactgctataatgtaggctaactttctttgacctctgatgtgtaatagcctcatatcttaaaacccccactcagatcatcctcttttattatgagctatttcatcgtcataccattgctgcttcccttaaagagcatcattatactcttgacattattttatcagatggacttgtaaactatctaattccattaacaaatctatgaaaaaaggggtgaggagggcaattcttttaattaacaagttgattttataccacaaaataatggaactaccttgaaagcaaatttaaattaacagctttaaatgagttggttataaaatgcttagatacaaagaagaaaagaatgaagcagtaaaagaagataaagaatgaatatcttcttcaaaagaaggctgtatagatacctatcactttgtggtgaagctcttctagtatactaaaatatttgatccagcacagcaaagagtcttagagagagaggaaaagaaagattaaaacaagacctaaacatgatggtttctgtctcttgtgttgccgtgctctgaaacttggccttattttaccctttagtttctgctttcccccacccttttcctatcctgtgttttgtgggtcatttcatttgccattctctgcagcaaatccaaaaagaaatcctaacttgtggttaacagtattagtacctccaaattcctaataacccctctattcctctgcattcaatcgatttgacgctctgttttcaagattgtatattttgcatttttcatcagaaaaataacagtatctgctttatcaacttaaaattaattgatttcagaatatatctatattatgacagctgattcatttatgcattcatcagtaaacattgaagaagtgcctaaggtgcttcagaaactatgttaggttcttattaggaaccaataaggaaataaaactaccaggtgcctggctctcatgatcccttctgtctagtggaggagacagacttaataacacgatcgcatgagtcaatgtatcatcacaaactgagacaagagctgtcgtggaagaaatccatttggataagcagaaaaatctctgtgaaacgcccggatgtcaaaaatgatttccctaaagaagtaaaacttgagctgaaatctaaccacaagaagaggtggtggtggtaggcagcatatcataaaagaagcatgtgaaaccctacacaagggaggaatggggaagtttgaggaaccaagagatgaccagatatgcaagggagtatggcggaagatgagactaacagggcggaatctaccagggcatttggcacctcacgtgctttattttgggtctcagcctagtgcaatccaaagctgagagagaattttaaactaggaatagatggaagaagtgagtagccaggacatatttgcactttgaaaagtctactctcactgagatcattttttttttcttaagtcagtaaatacaagaattacatatttcaggatatgagaatattttccctctatttttgattgaattttaatatattacttactgtttatttggcccctaagctaaacattatttgctgtgtcagttttgaaatcatgtatcaagtctgtaactaacctaaaaaatttaagtagaatgtatcctttacatataggataaaagacaaaggtttttctataaatttaaaatattgtataagtgaccttgacaaagcagcagtttatgatacgctgtatctgacctgaaagaaaatgttttttgtttgctttttgttttttacttaaaattactcctgtattacatagcatagaacaagttcccaagaggttgtgagccggagttttggggcgtcattgccccaatgcatcagtgcaatgcatctttcctttcagtgggaagagaggaccatgaaatttgactggattcctcttctttgtttggctgatctccggtattggtttgctttttctataacatgtccttgagcagttttccaagtaggttattgctccttgtgaatgttctcactcggaagtgttttctatagctttggcccctctcctaactacgccttatttttaaatgatttgccttgttgagtagtatccaggttagggctccaacaatgtgggccatatcgtggcacatacaatatttcaaaaaataatataattaagaaagtaatattcttttttttagatagtgtcatttgtttcattatactggtcttatctttcgtttcattttccaggtattctataaagatatactttcaagaattagacccactgaaattacataaatcttaccagtgaaagcagggacatcttgctgatgagtagctatgatccctcccttttcttatttatttttgtttttattttatgtttaattgatgctaattgtgcatatttatgaagtgcagtgtgatggatgttttgatatatataaagcttgtgtaatgatcaaatcagggtatttagcataccttcacctcaaacgtttatcatttctttgtggtgagaacattcaaaattttttcttctagctattttgaaaaatgaaatatagtactgctaactatcgtcactctaatgtgcgatagaacacgatcacttattcctcttgtctaactgtaactttgtacccctccacctatctcttcccatcctttcacccctgctcctccccatcctctggtaactactgctctactctctacttccaggaagtcaactttttaaatttcatataaatgagatcacgcagtatttgttttctgtgcctgacttacttcgcttaacataatgtcctccaagctaatctgtgttgccacaagtgacaggatttaattctgtttttgaggctgaatattattaaattgtgtatatatgccacacttactttacccatttataggttggtggacacttaggtttatttcatatcttggctattgtgaataatgctgcagtaaagatgggggtgcagatatcttttcaacatagtgatttcatttcctttggatatatggccagcgccaagtggtaggattttttgatcttatgttctatttttagttttttgaggaaccttcatactgtagtccatgatggctgtagtaatttacatttccgccaatagtgtgtaagctttgctttctcccgtccttgttagcatttgttactttttattatgtttatgatagccatttaaactggagtgaggtgataatgtcattgtggttctaatttgcatttccctgaaggtaatattctcgatagcagaagaagcagtatgacaccttctctgtaaatttatgtttcttctcaatagtcacttgtgtctgtgacctctggtgtacatagtatacatttggctacctctgaaatccttctttataccacccacaagtaaaagcaatgaatagaactttatcatcactctattattcccatggttatcttaattcacatactatattccatttatttatttattcaattaattattattgattgattaataataaactaacaattatcactgtaccaggtactggaattacaaaagaggaaaaggcatgatttctgcattcaggaacctctctgttcagtagggaagaattgcattaaaaatagatcatcagtagagtgtgataaatccatcattagattcatgtttgaaatgccactggagcacagaaataaaaactatttgggagactatgaattatgaaatggattaaatattgcagattagataggacactacctattgtatatatttccagaaataatctaaccatgatctgatcaaatttttataaaacagataatggtttacattttctcaagtatcacagcagttaattttaatttctgtgatatcatcctgctttacactgcctttcatgtcagaatgaatccctatttcctgaaaatatcctgcagcttacactgactcttctgcaatgaatcatgcctgcagcctaagtacttggtgcctcatgatgggggcatattatgttcaataacgacatgagctgacaaatgtgaggatttgttttaactgtcacatcagttaaagcctgattagatgtccttatcaaaatacatactgataagacagctgtgctccacttttgttttaccaaacctagcaagtattttatttgcaataaagaaactgaagggccatcaaattgtgtagagccatctgcttctgaaattagtttcatacaggggatttaatccacagtaattcttatctacttatgatcttggaaatgcattgtgttctttaagtctacaattaactacgagcatctaattctactctatcaccttatatcaagtgtgttagcgccattttccaaatggcaaaacatggtaataacccaggacttatgcatgataatgaatcatatcacagggctcagtctgtctaaaaaagtactaggaactctctatgcctgctaagaagcatatggagaaacatgacatatgatccagtttataaaagaacaacttaaaaatttaatgtagttaagagcaggtgggaattctataaataatgagtcagactacattttgtcaacatctcaattgggactgagccatatattgccattgcttaattttcctcagcctcttggactataggataacccattaaccatattttattcatctatgtgttcctaggggcatctctgacccatttttcacaaaacataaggaattcatgtgcaaggttgaatatatgtgagttagatcaaaggtgttttaagatgtttaaacggcttaaattcattttaacaagatgtctttttaagacaacctttcccaagccccccaaaatcaatatctatcgttatttgcatctacagtatatggcaccttcttatactatctatatatagtctgtcaaataattagtgcactgcctggcttccacccctgtttgttcccaaggctgttaatgctgctgcttttcctcactaattctaaggctttgacacacgttaatgtgctctgacccaaacaatgagcaaactttctggttcactaacacaattgctttttgcaaggctatgtctaaacagaccactatgagagatgaatcttcattccctggagtttagcagtccaaaaaaaaaaaaaaagtagagcgtataagtgtgatgaaacatgtcttctgttattaagaaaaaaaaccccttgttttatataagcagaaacaagtggagtatactataggttaaaatgttaatatttgtaacatagcaattttgacttattacagtgtcctgtaatatatttcctttatcaaatgaatgcacataaagtggaattttttaatgagaaacaagtatatttatgtattccagatttattcattttattcatatactatgtgttttaatgtgtacttatacacaaataaatcaacaatatataaatgaatagcctttgaaaactatccttttaaaactagtaaaatgcatatccaatttaacttttgaatattaattacagtacttttgaacctataaatacagtaagttctaagattcatactttaaaaaatgcaaataacatgaatatcctttgatttattctttcaatttatttaaacaatattcaattaattgacatctgtcaggcagtggggatgcaattatgacctaatcaaacttaattcccacccctttgggtagatttgattacactttagagaagaagatggataataaagaagcgaacaacaaataaatatctaaggagaaattataagtaccataaaagaaagaaattaatcaccacccagatgaaaatagagaccatatatctgagtaaaagagtctcagggtggaaaattatggacttggatctatgctctgatggtaggggcttggactttttcaatgccgacatcgaaaataaactatcccctaatatgaaacctagtaatgattttacaaagagaaaattgctcttagacagaaacattctaatgttctatgtgaaattaatcaggttttccaattagaatagcaatgagaaaagtattacaacttaagagcaatgcagtattcattttagtgtgtttaccctacttaaagtgctttatggtgtaattttgtgtcatgagatgaagttaattaaatttgataattctgtattattccttcaaataactagagaaaaaattaactcactttccacatgtttatgggactaaaagaaggttgagaatcactggcaaaaatagtgtggttcaactattatgccaaatatgtaatttatacattttacatcagattgagaaaatccttgtcattcttttccttggttttgtgatttagaaaacaatatctattacatgtaaaactagtaaatatattacatttaaatatcaaatatatactgataagattaaatgtactgagtttatcctaaatagaatgacattgttacaagaattctcttttgactttatcactaatgcttagtgatagacttaaatattattaagtacagtgatttaggaactttgtgtggtagatcctgtgtttgggtgtttcttctacaatatttctgtgaagttaattgtaattaacagaaaaaaaaaacataggaatataaccatactgttttttatttttaagatactcattttatttaaaatgtattcatggtctaataaatttttctttgttccctaaattacaataatgatcttagtagtgtaaaaaaaagtggatattgacttacatacaagcttgatgaaatgtaactaaaacagacacaaaatggaaagattctgattcattaagacaatattgttaaattattaatactacccgaagcaatctacagattcaatgtaatatgtatcaaaatcccaatgtcattttatatagaaatagaaaaacattaaaaaatccatatggaaccatgaaagaccataaataaccagatcaatttggagaaacaagaacagagctggaggcattattgttccttatttcaaaatatatgacaaatctatagtaatcaagacagcatggtactggcttaaaggcagacacatagacaaatggaacaagaataaagagctcagaaataaacccacacacatatggtcaactgatctttgacaaggttgcaaagaatacacaatgagcaaaggtattcttttcaacaaatggtgttgggagatctggatatccacatgcaaaagagtgatatttgattgatatctcacaccatacataaaattcatctcaaaatggattaaagaattaaacataaggcctgaaactgtaaaactcctaaaagaaaacaggcaaacaccttcaggacattggtcttgacaatgattttatggatatgacaccaaaagcacagatacaaaaagcaaaaatacagtgggactacatcaaattgaaaagctcctacacagcaaagggactacagatggcccctagcttatgatgatttcacttacaattttgactttacaatcgatttattggggtattgaatgcatttttgacttaggatattttcaatttggatggcttcattgggacataacctcataacaagtcagggagtgtctgtaaatcagacagtgaaaaggcaatttatggaacgagagaaaatatttgcaaaccatatatctaataaggggttaatctccaaaatatataaggaattcctacaactcaatagtaaaaaaataataacccaacttaaaaaaagggtaaaggacttaatagatatttctccaaagaagatgaaaaaatggccaacaggcctgtgaaaaggtgctcaacatcactaaatcatcatgtaaatgcaaattcaaaccgcaatgaaatatcacctctcagctgtcaaaatatgtattgtcaaaagagggaacgtactggctaggatgtagagaaatgggaaccctcgcacacagttggtagaaatgcaaagtggtacaactgttatagaaaacagtgtggagattcttcaaaaaaataaaaataggattactatatgattcaagtaaccccacttctgcatatttatccaaaagcattgaaatcaggatcttgaagatctataagacccttatgtgtatggcagcactatttgcaatagccaacatgtggaaacaatctcagtgcccgtccccagacaaacggatataaaactggggcatatgcatagaggggtgtgcctttgaacctttaaaacaaaggaaatctgccaaatatgataacatagatgaagcttgaggacattatgctaagtgaaataatccagttatagaaagacaaatgctacatgattccactttaatgaggtatctaaaatactcaaattcatagcatcaaagagcagaatggtggtggcaaggggctggggtttggagagatggggagttacttcctaatcaggggcttacaatttcagtcaagcaagatgaatatgctctagagatctgctgtacaaatttgtacctttagtcaataataatgtacactttaaatacttaagagggcagatctcatgttgagagttctgtcttattttcaccaacctgtatttcatgagtaagaatttataagacaaaatttagaatactgatcccagtggtttgagataaacatgcaaggccagcagacttaatttactttgtttataatcaaattgcaattggagacgcaagaaccattctcaccgtgctgcttctgaacattacagccatgagaagaaggtgccaaactttctaattacttcacttttcttcgctgtgaggagctctagactttaagagaatggttccttttctgcctctgtgctcacattgagactaaaagcaggttgagagaaatgatgtacatagtacatagccacatttaaaaatcttactgatactttcttagttcttagtgaaatgagagagtaaggtaaaccactctaagagcctatgcaactccaaattcaatgtcactattaagtcatatttggtagtatagtaatgcttacacccattattaaaattttgctagcctattactttacaatttttaacttaaccatgatgataatggctgggcgtggtggctcacgcctgtaattccagcactttgggaggccgaggtgggcggatcacgaggtcaggagatccagaccatggtgaaaccccgtctctactaaaaataaaaaaaaattagccgggcgtgatgggggcgcctatagtcccagctactcgggaggctgaggcaggagaatggcgtgagcccgggaggcggagcttgcagtgagctgaggtcgtgccactgcactccagcctgggcaacagagcgagactctgtctcaaaacaaacaaacaaggaaacaaacaaaaaaccatgatgataatgcagcaggaaagttccctgactcgttcatgggcgggaactggagtgcatgggtgctgggactagctggccacttaggtgccaacaggggtgaactccactcattggaacccacagtgttccacccctcgcgagaaggggagcatgtgggtgagtgagtgcaggggccagggcgagtgcttttgggagccagcaggagcaaactacattctggacctgcagcagcatctggggggcatgctgcgacccctgaagccccagaaggagagttacaatgtccttttagctctactatctgtggatggtttaactgttaacagctcagtgcagggtcagtgtgacagccttttgtacccacactcatggcacccgagttcttgtctggtgtccaggagggatgaggacacatgaatgaattgaagatggtaaatgtaggggattttattgctgatgcaagaggctctcagtgggaagggttgctgagaagaggacagagtaggaaggtaatcttcccctgaagccaagcttcctggccagactcctctcctaaagctatgccattaagacatccctctgaagttaagctgcttctctctaacatccaaccatagtctctgacatccagctgcttctctgttagctgagcctggggtttttatggggacagaatgggggatgggacaggctatgactggtgggaaaacaggggtgtaagttctcactttgggccatggtatcaggcttttcagcttgagggtggggccctagctggggactcaacctcccagaatttctctgccttctgtccctatcaatagtagactgtaaatgcatttaaattatctagataaaattattgaatagaataaaatttagtagaattaaaaaaacacacaatgtaaagcttttccttaaatattacacaactcttgattctaactgctttttggggaaaatcaaatatcacaaaaatatataaatagaagatccagctttaataactgattttaaaaaggattgtttcccttggacttcgcattcttggaataatcttctccccctgccacccctcctaaaagagtgagagaggccgggagtggtggctcacgcctgtaatccctgcactttgggaggctgaggcaggcggatcatgaagtcaggagatcgagaccatcctggctaacatggtgaaaccccgtctgcactaaaaaaaatacaaaaaattagccgggcatggtggcaggcgcctgtagtcccagctactcgggaggctgaggcaggagaatggtgtgaacccaggaggcggaggttgcagtgagccgagatcgtcccactgcactccagcctgggtgacagagtgagactccatctcaaacaaaacaaaacaaaacaaaaagggcgagagaaagtgaaggcagaaaagcagaaatgaacaacagcagtggcagctctcctgcaaacaccaagaagcagccacccaaaaggactgtggtctgggaatgaatttcccctccaagttatagtgctgtaggtgtcaactgctaaataagctttagcacggggtagcagttaattgatgtaattgattatttttcctcaatagaaaactgcatcttctttatgtacaatcgtatcatggggagagttaagtttagacaatttgaacaagatgtaattatcaattatggattcctctgggtccacggtcattattatcttttaatgactttgttccttttcatatgattatttggaaattacatagttattgttccccttagtgaattgcaaaaattttctaacacaatgacattctaatgaaaaaaacaaacctagtaagatactcgtatcatcctttggatattttgacaaagcatgacttaaaacaattctatggggaacaatgaaccaaaatgacacaagtgtaccacaaaacgatttcatttttgatgttccctgctaatatttttattgaccttttaagtttatctaagagctttttaatgcaacaggctatgttagtagggctgtgtgtgtgtgtatatatatatatatatgtaaactttttttgcacaatatcatacatttcagtctttatcacgctgggaacaataaagtaacagactgcaatgcattagcatcataaagaaaatgtaataaatgactttataactgtagtaaaagttgcatgagcaccagcagctgtaccagagatgttgctacagcagcgctttatgacctaatggcactcagtgggctgataatattatgtgtgtgtgtgtgatgccagcagtttccaaggcctagatttcaattcgataaataattgaaagcacttttagactttcccataaaatgtttaacaagggatcaaatcctccctccctgtactagaaaattaaatagtttttatgggagtattttatgatgaaatcctaactactaactgtgggaaaagtggtatttttaaacacagcagttgaaaataactcctcaaagagttcgtattgcattgaatttgatgaacagttctttcaacttaaatttttcttctttgcttaagtttctggcttttcaattttgaagcctgcctgtaagaactgggttttttgaaatgaacgtgtggaggatggcacagtcatggagcactgtggacacgaatcaggaatgcacataggctagaggactgcagtgagtcaatattctggaaatgacagaatggatattcctgtgctgtcagtgtgcaattcaccatgggttctttacgctgttaaagggggacaaagaagtgagactgacttttctcctctctttaacagaacacatgagatgtaaaatgagtgctctgtgagtggttaaaaatttcttataatgtacatacaatctatgagattggaattttatttaaaatggagaaaacaaaaaatatgtttccttcaaataagagaaatgttaatggtaatttttattactacgtgtgactttttttcttaagaggaataatttcataatttttgttaaatgccttgcttcttctgcctgtttttggctgttcagagtctgaagggaattagtgtatacactgcatcaattgaagtgaggttactaatcaactgtcataaacattgtctgtcaatgacgccatatggcatatgttcttagttaatccaatatacatcatgagtgggacatcatcttaatgtgatatgaaaagacaaaaattacataaaatagtggaatctctctgagactaacttgtttaaaactatctcttgagaatgatttaacagaaagtagaaaaaaactagcaaagacaacaaaaaagaacacttaaaaatggttagactatatatgctaaatgtgaccacctcaactccccagtagctccttactccaattccattaataaacaaaagggacaagaaacagccatcagtattcccactaacctaggtgtaaattttgagcaaagccattttgtctaaagtagaacattcttctccctcattttttgctttatgtttataatattttatttgcttttgtaatagcatattctctgagaagaaaaaaagctgttactatttgccatcaggatgaaaaacgtaaacgacaggtaaataatctcatcttaagacaccgtgataaaatgagcatgaagttgaagagactctgagatgctcctaccatctgcatcaaataatggaaagatcattactggatttgaatgttaactctgcccctcagtagctgtatgactttaaaaaaaatcgtatggcttctgagatttgaaatgtatttaatcacggactgatgtgatgcttatggaaattactaagcagacagcacataacttaggaaaaagcagatcccagtttgttgcaaatgtttcttactgtgtattttgctctccctctccctttctctaatagctcactgaaattcaaaattccagaaagtttgagatgacatttccattggtgttcagtttttgagcaactgttttgcccatatttgcatgtctctattgtaaaaatttcaatatcatcacataaagcatcctaagtttcttcctgtacagagatgacaacaacattgttagaggaacaaaaatctatggttttcccagcagcgtctgaatgagggcaatctgcgtaactacacacaggacttccatcccaatgaaaactcctatcctttttcagtacaactgtgtaagggtttgaaggaacgtgataaatcaatacatctcttgaccacccatgcttagaaccaacaaagaaatagaaataggagtcagagagagggagacaatactagctatatttcttgaaaaaaatgttagcgggctaggtaacagaaaacatcaaaataagacagactttccaaaccagtcaggctgtgttagataaatcccgtagctacaaaacttaaagcacaggagaatagcacagaatccagcccttctccaagacaaaatggagcaaaagggctgaaccatacatgttcagggctgtcttctaaactcaatctaccacactccctttcgggggaaagaagagtaaaagaacagggagcaattcaaatgaaacttcttccacctctgagagatggattaaattctccgttagcattttttgttttctttggcttcctttgtttcttcaaaccatagtcagccacaatgtgctgttttcatgaacgatactggccagcctggaagcacagacctgcttccaccttgatgaagctgcttcctgcatagcagacattgcttctgtggatggatcttcctgatgccacttcaatgcagtgttgattttgttacatggtcctgaaatgtgctaaaatggttcataagtatctcccactctgcaccaaagactgaatgtcctgttttccacctacatgctgtcaaggtgcaccagccaataagctcatctcctcttcagtgggtcgaaaatgaatgttaaaggtgtgcctgttaaaactgaaagaccaaagaaattaaagttgaaaactaattttcttactcttgtggttagatgatttattgctcaagacttttaaaaacaaactctccaagcccctccccaaattccagtgttgtattttgcttagccttttcccgaaggattccccacgcagggttgttctgggttgggggtctgtcttcctgcagctgaagtcagacctgaattgcagggcaatgtgtgtcattcttttcaaattcagaagatgaaatcagtgagtctctgttcattctcaattttaagcaggacaaacaatgaaacaagaaggataacccaactggccctgtatggtaaaagtttagaaaacaaaatcagttaccgaaaataaaaccatctacctaaacactactctttgggatcatggaagaccgcagggaagactcaattactcaaggagggagaatggaaggaaaaatcttcttagccagggtgctggccaatctatgccgtatgttcacagtccacataataactcaattgaaacaactcttcattaaatgtttacttttaatagcatatttatatggaaaaaagtcacccattgtaccccatcttctctttcttaatggaatttcaatcactgccgctctctggcaaaggttataaatttgtgatgctagcagcccaaacctgggcctcatttcaaaccacctttatcccacagaacatagttaaacctcttaatttccatttcctcttagagcttttcatttctgaaccatagagacacatgatgttaaaatctgttagaagctgatgctattgctcctttgtgtggaattactgagtcctctaaaatctaccccatccacgtaagtcctaatggttttagcacccatttgtgctaaacggctccatgtccctatttttgtgtcagctatcaggtcatcatcggtaggctcctgacactactgttgattttcctgcaagtgaagtacatctgctccaacttcccagggtaatcttcgcttatcattttcggatatttcactacttcttcccagaaagtgtcattaaacctccttgtaaactcggttcagctccttcagtggctgcatggggttgataagatttctggactgaattgtttcttctattccttttcctgtactttctggtatagtaacaattcacaatattacatcttatggggatacctacatgcttattgattacaaatcagtgagttctgggcccagtaaaaccattcactcatcattcaaactactcactttcatctacaaaacctagagatgggtaaccccacaaaacaagttgtttttcaacacaccaccatcaacaacaaaaaaacaagcctggactattattttcctgccagattcccctttcagaggctcattttgatttgcattcttttagcggtcttattcctcaaatttctcaagttattttcttagggaataggcaaaaatagcatgcctacccttaattgctgtcgccgcaaactcatggaataattttttgagagtttgatctttccaaactcttctaaaatttgtacacattttaaataaacagtagagctgtcccaatctataaggtacattttcccaatggctctaaatacaagcctctttttaaaacatcagtgtcttgcattctgaatccctctgcatgcatcatcttggtctgctctctatgcattatgctatgtttcttgacatccttgtcataaaaaaatacacttttatcttttagagcaatttgaggttcatagaaaaattgagaagaaggtgcagagatatcccttccccaacacgtgcacagcctcccctattatcaacatccccaccagaatggcacatttgttaaaattgatcaacctgagacacatcgttagccagagtccatagtgtacattagagttcacttttggtgttgtctactccacggatttgtacagatgtataatggcatgtatccatgattatagtatcatgcagggtatttgcactgccctaaaattctcctgtgtactgcctactcatccctctctctcccctaacccctggcagcagccactgatgtcactaattttttttttttttttttttttttttttttgagatggagtctcgctctgtcacccaggctggagtgcagtggtgcaatctcaggtcactgcgacctccgcctcccaggttcaagcaattctcctgcctctgcctcctgagtagctggaattacaggcgtatgccaccacacccagctaatttttgtatttttggtatagatagggtttcaccatgttggtcaggctgctctcgaactcctgacctcatgatccacctgcctcggcctcccaaagtgctggaattacaggcatgatgatctttttactgtctatacagttttgccttttcaagagtgtcatatagttgaaatcaaacaatatgtaaactttttggatcagttcttttcagttagtaatattcacttacagttcctccatgttatttggtggtttgatagcttttttagtggtgaataatatttcactggatgtaccattgtttatctaaccactctacagaagtacatcttcattgcttctaaatcttggcaaatatgcataaagctgctatatggcaaatatgcataaagctgccatgtgcaagtatgtgtgtggacatacattttcagctcctttggataaatgccaaggagttaaattaccgaattgtacatttaaaaatatgtatagttttgtaagaaactgctgaacttccctcttaagtggttgtacctttttactattttgaatccctaccagcaatgaaagacagttcctgttcttccacatccttatccatatttggtgttgtcagtgttctgaatttttggcattgtattaataaatgcacagtggtatctctttgttctaatttgcatttctttaatgatgtatgatgtggaataactcttcatgttcttattttccatctgtatcttctttgatgaggttggcttcagcccatttttaagtggatggttttcttcttgttaaattttaagagttctttgtatattttggaaaacagtcctataccaaatgtctgtcacaaatattttctctcactcagtggcttttcttttcattctcttgacagtggctttcaaaaaacaaatatttttaattttaatgaagactacgttttttgcttgtttcatgttttttttctgtttttcttttttattgttgttattttctttttgaggcaggatcccactctgtctcccaggctggagtgcagtggcgccatcttggctcactgcaacttccattccccagagtcaagcgatcctcccacctcagccttcagagtagctgggaccacaggtgcgccaccatgcctggctaatttttgtattttttggagaacatggtttttgccatgttggccaggccggtctcgaacactcctggactcaagcaatccacctgccttggcttcccaaagtgctgggattacaagcctgagccaccgtgtgaagccagaagtctaccttatcaattctttctttcacaggttgttatttgcttcagtcatttctatggaataagaactaaaaacaaactattttcagaataccttttttaagaagtcatactactcatttttttttccagcttcaacttcaagatgactattttttttaaatttagcttcgtctaaggtcccaacatttcctataataaatatcttctcatctttctgccaaatcgtttttttaattggtcttcatatttcatattttcaacagattcagctcctccttgattttctaagtaaacttgagtcttagagacaatatctatcgacagctttttaaaatagtgtacttggcctttgggtttacagtaaatttattgaattatttaactaccttaattcagaaaaatggtatatatatttgtttgtaataagtgtctactacttttaaattttgtattgagatatgatttgcataaaagtacaatgtttaaaagtaaatttttagtgaatttgaaaaggtataacccatacttgaaactcatacttgaaaaataatagagaatatttccagcacatccactgtactcttttctggtcaattttgtccccagacttctaaagtgaattggaagttctgattttaaatcacaatacattatctttgcctgttcttaagctttaaataaaaaaaaatcctttcctttattctaccaacttgtattttcttttctttggttctaaggtagaagcttcgttttttgctttttgtaacaacagacatttaaagttataaatttctctctaagggcaccttacttgcatcccacaaattttgatagtgttttcattatcactaatttggaaatatattatttctctgagttctttgatcaatcggttatttagaagattgtggtcaccttttagggagtattttttagttattttttgctatttctaattgagttctgttacgatcagagaacatattcagtatgatttcaattttttaacatctattggtttattttacaacctggcatttttctctctttgtgaatataccatgtgtacttcataagtgtattctgcaattgtgattatacagttcaataaaactcagtaggttaggttgctaagaatattattcaaatcttctatatccttttaaaatctcgtgagtggaatcttaaaatctagaattccatgagtctgtctcttaaatctgttattaaaaaccttgttatagtagcatgaatatttagaattcctttttgaaatggagtctcgctccctttaggctgcagtgcagttgtgtgatctcggcttactgcaacctctgcctcctgggttcaagcgattctcccgcttccacctcccgagtacctaggactacaggtgcctgccgctatgcctggctaatttttgtatttcgattagagacagggtttcaccatgttggacaggctggtcttgaactcctgacctcaggtgatccacccgcctcggcttcccaaagtgctgggattacaggtgggagccactgcacccggctgtaggatttgtttttttgatattgatatttttatctttttgaaatatgcttcttcatgtccagtaaaaacatgtctcctaccttcaaatccttgatatcattacattcctatctattatattggatcaaagatacattgtatctacatacatacacatataaacacattatatataaaggctttaatattctgtaaacagtatgtcagtggatcttttcaaacaacctagaaatctcttaaaatgtttagcttattcacatcaaatgtaattattgatatgattgggtaaaaatcttacatcaagagagtcttactctgtagctcaggttggagttcaggggctcactgcagcctcaacctcccaggctcaagcaatccttccacctcagccttccgagtagctggaaccacaggcatgcgtcaccatgctcagctcattttaaaagttttttagagatggagtctctgttgtccaggctggtctcaaactttttgcctcaagtgatcctccagctttggcctcccaaaatgctgggattacaggtgtgggccaccacaactggccagattattacatctcttatttgttcatttattccttatttcctaccatttttgatattaatatttcttttcttttttttctttttagtattttaatttgtctcaaattagtcttcagaaatatgtccttgtggccgtgtgcggtgagtcatgcctgtaatcccagcacttggggatgccaaggccggtggatcacttgaggtcaggagttggagagcagcctggccaacatggggaaaccctgtctctactaaaaatacaaaaaaaaatagctgggcctggtggtgggcacctgtaatcccagctattcaggaggctgaggcagaagaatcgcttgaatctgggaggcagaggttgcagtgagccaagattgtgccactgtactccaacttgggcaacagaggaggactccattaaaaaaaaagtccttgttttacttcttaatagttgctctagggtttcaatatatcttttaattgattttctatcattttacattaaataaattatagaagtaaaatttttcagtcctttgttttatcatatatttacttctatatatgttacaagcctcacaatctttgctattattttttgctttaaagacccagtggtggccgggcatggtggctcatgcctgtaatcccagcactttgggagcccaaggtgggtgggtcacctgaggttaggagttgaagactagcctgtccaacatggtgaaaccccatgtctactaaaaatacaaacattagcttggcatggtagcagaagcctgtatttccagctactccagaggctgaggcaggagacttgcttgaacccaggaggcagaggttgcagtgagcaaagatgcgccattgtactccagcctgggcgacagagcaagactcagtcgcaaataaataaataaataaaataaaatactcaatggtatttaactaagtagaaggatgcagttttttttaaatatccatatgtcatcacttctgacactattcttttttgttgatatgaatttccaggtgtagccattttctgtatcactttgtagtgtttccatggttcactttttttctctgcgtttgtttgagttcactgttgcatgataatttcactagtgatccgcctgcctcaacctcccaaagtgctaggattacagaggtgagccactgtgcccagctggtgtgattgtttttggataagaagtcagccatcattttccttgtcccactgtatgtattgtgtcttatttcactgcttaaaagtatctgtttatctttcatttccaacactttaatagtgatctctctttgtgcttttatttttatttatggcctttttgggaccatttatgctccttactatgtggcttgatgtcttcttcagattgataacaattttatcatattttccaaatgcttttttataaataagaaatatcaccctagaatgaaatatcattctaggactaaatattagatgatattttctcacaggtagtaaatgtttaattcatgttttttcgaacttttttctctgattaaatggacacaattctattaacctgttatcaagttaatttatccgtgtttctgccatgtctaatttgttgaaatttatccagtgtagttttattcacaaattgttttttttttttctagaaagttcttctggttcttttatttctcttctgaaataaactgtctccttacccttttatatctttttctgtaaattctttaaaaaaatttataatattaaaggtttttatctgctaattccaataattttgtcatctataattctgcttctattgactgctttttctttcattatgagacatattgttctgcttttctgcataactcttaatttaaagaatctagatattacatataaaataataagtgtaatatttttgtctcatttttttcattttcccagagactacaactctttttttctatatattgtctggcatttatggtaagtagaataggtctcatctgtacctttaattagatgaattcacctgtgagtagtcccaattccactctcccaagctttcacatttaaaaatgtgcaaatatttaacctgggatgggttgactactattttagatatttttcgggttttattctgatacggcccctggattcaaccactgtgagaatgtctgtgacataatttacttaccatttcttttccactgatgctttctagtcataattttagcagtgtgtgtgtgtgtgtgtgtgtgtgtgtgtgtgtgtgtgtgagacttgctatactgaatgttttatttttggatttacatttcttccgattccagtttatcttgccatcccacactatcttctaaggcttgattgatttcatattattactgttatctcagtctggtacatccattatcagatactcacacaaactcccaggtgtggaatctttcttggttctctgtttccttatgaagagatattttttctctggaatttagtgcaccaaggcttatttttatctgctaccttttactgtctccataagaatatataaacttattttgtctgggttttgcttttctgtaaccataggagtattgttctttcagatgtatctacgacctaactagtattagatacttcctatttcttcctatcccgttaagaagaccattgcttttctttggattaatacatagtttgggtcctgagatcttagctcaggaacataatttacagaattagcaaattgaaagctaactcaagagcatgtagaagatagtggctaaaggacattctacttgaattcagagtttgtccttcaatgttgctgtctagtggccttgaagacaattctgaatgtcttcaagaatgtggcagaggttctatataattctagaactgtatagtttttcttaacatgaagggtttaaactagaacttttcctctctagggtaaataaaatagtaatagcttgcacttactgaaggcttcctatttgtcagagtacgtatgtagctaactggtttcacctaaagcaatcctaggagatatttaatattatcattttaattcatagatgaggaaaataaaatagaaaagttctaataataatttcacagttcaaaatggcagcactggaatttgaacttgactgtttctttccagattctgttatttaaatagctttgttctattagccctccaggagttgcccacgagaaaaaccacagtaaagtaagcactatcattgtcttcctttcatggagaccttttaatgggactaaaagtctctttaagtgcaattttactgaatgtgccactttttaatgacgcttggtccatgcatttcaagatctgctatagaataggttatgtaaaactggcttgtgtgtgggttgctaatctacctcttgttaggtggcaaaacctttgtgcctgctgacatgaaacaaccattcacctgtagaaacacaggcttttatcttggagaagactgcctcatgcttcagtgactgcaagttcaaatgcctcaggatcctgccgcgaaaactggcgtctatagtgaccagtcctggaaccatcaaaagcatctctgttggttatttcaatcccaaattccactcattgtcaaatactaaagagtctcagtgtgggtttgacactcatattttctacccaaatttggatcaactaagaaatggacaagaatccagcaaattgctatattgcagataaagtctgggttggaagatgatccccatgtatttggaattaatgggctacctagtacataaccatggtaatacagggaatggcccctccagcctcagatggggcttggaacatgtcaggactctctcctccttaccctagatgcaaagccttaggaacagccatgacatagctgtatggggcaggtgttgctgtaagtagagctatcccaaataaaagaagatgagttacattatgtatctaattagctaacaaatgaccctaataatactccaaaacaagtgtgatgtgttctctcacgggacgggggtggtggctcacacctgtaatcctggcattgtgggatgtcgaggagggcggagcctgagctcaggagttccagaccagcttgggcaacacggtaaaaccccgtctctactaaaatacaaaaaattagccaggcgtggtggcacgcgcctgtagtcccagctactcaggaggctgaggcaggagaatcgcttgaagccgggaggcggaagttgcagtgagccgagatcgagccactgcactcaaacctgggcgacagagcgagactctatctccaaaaacaaacaaacaaataaaaaacaattggggcaggaagaacagatgtgttattctaacagaatttcctcttcccaaaggcaataaaagtcagagataagcataatccacaatacacttgattatgtcttcttgacatttgtccctgcctgattctctaagtttacttttggaaaagcagatgtatcacattcattccactgtataacagctagtggaaaggagtgttgcaactatgtaccacagtggaggtacatgtcatccttctgaattatgtcatattgaacttcaaaagatttaacaaattctttgagattttaaaatcttttaatttcctcaagaattcaaaattttacctagggaattctcagcaaaatcaccaagcactgggtttcatggtgaatatgcagactttccatttgaacacttggaagaacttcttttacgttcctctcaggacatagaggaccttatggtccattctcctcccccaattcaattttctttcaggagagggtcaaaaaatcacgtgaggtttaatgtcaaataccatctgaaagcgttaatcgtcttagatttacctggaattaaaaataagtgaatccaagaaaatggcataaatttggaatttttaggcatcaatcagtgagtaaggagaaaggggtcttcctgatgtcatttagatgagagtcatcttctgtggtctcacatagcttttgtttcatcatcaggtaaaactaatttaaggaaatccataaaagccttatccctttaactctgaggcccaaagttttgcataatatcaatttgttttctggagtattaccaaggtcattgtttggcagattagattatcagtcaaattgggtgttaaatttcaagactgcatatttgggtgcaataatctaatatatagaaaactctatcaaatttttaaaagatgtaaatcaatatataaattgctggaaactgaagcacctgtgccacttggtactttttttctctctttttatagaggatcatttataaatagtaaaatagaacaaaatttatggaatgggcccacaaaaacacaaatgctgtcatgaatacgtacacagtccatcaccagaagggctagctgaaagaagtgttttgtttttgttgctgttttaaatcttctgtgaaaatgtttatggtgagattgtctgtctgttccctatgtaactgtccatgggataattcgctgcttgagtgtagctaaagaaatagatgtttatttggttttgtttgccgattgatctgtatgggtgatggcttttggtgacaactgaaatgttttctaattttaatgactcattttcataatgtccaaaaatttaaatctatattcattaaaatcccaatatactttgtgtaatcatatttactgtatgtgtatctatgactgcgtttgtggttttgtgggctcattacatgttttatcttattttatcatttaaacatatattcttccattgtttttatatgtatgctaccttctactttttaaaacagacaaaagaatatgacagtaaaaattttaatttctgaaaattattccatatttaccaaattgtaacaacttgccaatttataaaataataatcccagtgacacaactcataatatattgataaacatgttcagaaagctcatttttcccctactaaatcttgagattatcatcgtgggtcagtgaatgtctcccagagatgaatacacatagcccttcgaaatgattctttgttcctggatgaaaggtctgtctggctctacaaacatacaatgaatttgatttaaaaagaaatagtgtggcttctctccaacacttgacctcttcccctacagcttattctagagtcaaaaaacgtttttttttcctgtatctcaattatctctgtactgtcaatatttgtggggatatgccatttcagattttaaaataatttttgtcattagagttttttaaaaaaatagatgcttcaggcaagtccagatgatgattgttttgacttcagcagttcaactttcaaggcctgtggattttgtgcttatggtacctaaaacactgcataggtttttgcagagaatgcttcccactcagagccaccaaaaaagccagaggagacttcatccaacagtcaagcctacaccttgtccttgccctacagtaccagtggtgttgaaaacatcgtttccattgctttgtttcttaaaaatgtggaataaaataaagatgtaaagtgtttatacattattcagaggtaattaaatggtaagtaatgagctaaaaagcctgagtatattggattctgtgattccttgacctgaatttatgtgtaagttcaccaaacaaaacctgtacttgaaagcttgacataaccacagacatataacacatcatcctttgttatttacttatgtaaaagatttaggatggtggagatgcagagaggttcacatgtagaattctttcttcagattcacagatgaaatttattttcttggtattgtttgctccctttaaaaacaaatacgcctttcctatatatatacctactacagtgctttgtaaaatacgattttgaaatcatttatgcatcatacaattactttattatgttggaaggtaattttaaaaatgaaatatgaaattagaatagataaaaatacagtagaaaatgcagaaatatattacacatagaataagaaatgtttagtaaactttcatttcaattatgtgtgtttatgcaaattcatgcataaattgtgttgtaatgacaaaatatcattttaccatatcataatggtaaaatatatttttgtgtgtggaataggggcaaaagtgtttgtaagttactgatttaatgcctaacaaggcgtggttatataaacagccaatagctcatttgtagagtagacattgatctataaaacatattaaacacctcaggattatttatctacagtatcagaaatgtgtcaagcttgatataagagatcaatccatgttcttaagtctaaccctaagccttaaccttaagtggtttagaattaaagattagccaggctacatatttaaattttgccacctaggactctttcaagatgcctgaaataaaccccaagttgtgtcaatgttcctttcgatagtattgattgaaaatatcctctatgccaagccctaatttagacactggggacatagctgtgaagaagtccttacctttattgaatttacagtctatgaaaaaataggtaataacaatgaagccaattttgatataggtagggatataaaaatgatatttaaatatgatataaagcagcgtaataaatggaccgtagccatgggaaagtgttttagataggctagtcttagaatgtttctctgaagaggtgacattaaggaggaaatgtagtatcaaacagaagaagccgtgtgtgcaaagtagaaggtagcaatgaacctggtgtgtttggggaacagtgaaaaagccagtatggctgaaatgataatgatcatgggtttgttacaatacatagaaaaaatgtggacagaactcagaacaagtacagctttctctaacttttaagaattttggacattgttttgcaagtgatgggaatattttgaagattttgagctgaacagtgatgtggtctatatatttaagagatctttgtgactgtctgaagaacagatgatgagacggcaagcatttgaggaggaggtcgactaatgagtctgtgtaagtggtccaaaagatagttgaaaatgcttcagattaaggtgagaggttgtcacaccgaagctgtagttgtgaaaagtgctcagagctaacagaaatacttaatttgggatggaagggaaaacaatattttatggacattttccctgattaaacggtaatgtctttattattgtagactaaaattaaattctaagccccacccaaatgactgaatgagtcattttttggagaaggggaccccagagtatccttgaaaactgagttctcagccatgatagcatggtggggtcagactatcctccccttgctacccatgattaggctttcttccctaagagctcaataggaaccggccctttcaaaagactccaccactgatctcaaccaatctctggttgctgctccccccttcttgcctgataagaagccactgaccatggactgtttctggctagtaaagggagcatgcataggaagggtcctgatgttctctgcttcatcttttcacttcagagagccaaaaacttcaccctgagatcataaccattatttgaacatgaagcatgaagctcaaaagcacttgcatacgttttccctttcataaatattcatgactcctatagcttactgaatatgcatatttggccactctgctcagcataaatttctgttcccttttcccccctctccaagtatctgtggtttctggctggaggctctgcttctcagcctgtcagcatggtcaccctgctggctgtagccctttataagaaataaaatcttctcttctccttctctaaatttataaattgcatatttttaagttaacaaaagatggggaagtacacagatgaggcaggtttactttattttttaatattatatagtgaagaaaagacatggaagcaaagttctattttaaacttgataagctggagatgtctgctatgcttccaagtaaagatgtcaagtagacagtttcatctatggatagagatgatttaaaacttgggaatcaagattatatgtatgtgatcatttgactcctaagtttctaacgcctatctctgaattattcatccagaacgtcttaaactagcctttccttctaagatcttaacctacggcaaagacacacaagtggctctttgattaattctaccatcatttcgtattaatctgttcatgcattcattcatcaaatatgtattgaagtgatatttttaaatgtgggattcaaagagataaactgggaatgaaaagagagaggactaggcactgaacctcagagtatttcgacatttaaagattctaataagggaaggagtcagtccagaagattagaaatgagaagcctgtattttaggcaaaaaaccagattcatgtagaaaatactctaagaaggagtagaggctgtgtcaagtgattgcctaatgaaggtcactgggcttgacaaggtccattttagtagaatgatccttatggaaatctggttggggtgggttaaggggacagtgggatgtgaggccgtgcagactgctggtttcaactgttttttttttttttttgaggagtattcctattaacataaatgaaatcaggcttcagcagcgtccgcagcaagttaggaggccaaatatattttttttacatgggagatacttagatgttgatagtattttagcaggaaagaaaagttaataacatgggagaaaaagttgtaggaacaaattagttgtttagatgggagggggtaagactgtaaaaatgatgggttgaatttagataggaaccaagaaagtctatcccatattattccaaggaaagcaaagaatataagtgaagatacagtgaaattatacaaaaaaaagtaaaaaaaaagagaagagagaacaggtgtggtaggtttgggaagaaagaaaaactatgaaataatcatcttggagaagaggagagaaaattgatcagagaaactagcacaagattgctgagtagtgctggaggctcacttggtacttttttacttaaatctgtattaaaagcgggcgtgagtccttggttttctgtaatcacatttggctgcatgggtgatggcacaaagcagaaagaaaactggatttaaccagacctggggtgctgccaggtgaaaatgataggtggggagacaggcagaaaaagttgaagctgcatgttagggagtaattgcagtgttcactagaccactagaccattaaatctgaatggtttaggaagtaaaataatttcaggagggaggtatggacaatgtaaaggagggctgaactaatgtcaggaaagttgtaatagtaaaagtctgggtgtttgtgttcctatcataactgaaaacataagaggcactcattcaataattgcatgcccgaaattgggatttttttaaacctagttgagttattgataatgctaaaatttagttattgttaaagatatgagtagggcatttggtggctgagttaagaccgaaggaaaaaagttatctgcagataagtcaagaaacttaggggccagggtgttggccagatccctctcaaggatgtgggcactaccaggattgatgaaagaaatagtgctgagaggaaggtcagcaaaattaaatatttgccaagaagtcatattctttgtgtgtcaatttctttatgtgaagagtataatcagattaaatagatttttctctaaatttttagagaaaatttagagaaatctcttctttgaagagattttcttttaatttttaaaatgtttagccactaaaatggctctcatgattagaaacttttgaaaatttcagctgttaatcaaataactagaacctccctgatgcttagcaaatctccatttcctttgccacattttaatatttataagtgtttctagtcttaatgattttcatgtgtatgaaattattagttattgaggataaaaaacgaaaaaggcaggcttctatgtgtacattgtaattgggggtgtagtcagggtgagaaaaacataagaaaaatgaatcttaatgagaatgcagttacaataatccatttatttaatgactatttattgagggtgtcctgcgtaccaagtattttttttctttttcttttctttctttcttttttttttttttttttgagacagggtctcactctgtcacccaggctggagtgcagtggtctaatctcagctcactgcaacctctgcctcctgggttaaatcaattctcctgcctcagcctcctgagtagctgagattataagcacttgccaccacacccggctacttttttgtatttttttagtagagaggggtttcaccatgttggccaggttggtcttgaactcctgacctcaagtgatccacccaccttggcctcccaaggtgctgggattacaggcatagtttttgtgccacagattaagtggtgaataggccctacttctctagtgatcctatgctagaaccagatgatcccacatctgtccatttgaaaacccgcacatgtacactgtcttcagtcctgatgagaggagaagccagctggacttcatgggtcctgggtcgagtggggacttggagaacttttctgtctagctaaaggattgtaaacacaccaatctgcactctgtaaaaacgcaccaatcagcactctgtgtctagctaaaggattgtaaacgcaccaatcagcactctgtaaaaacgcagtaatcagcactctgtgtctagctaaagaattgtaaatgcagcaatcagcactctgtaaaaacgcaccaatcagcactctgtgtctatctaaaggattgtaaatggaccaatcagcactccatacaatggaccaatcagcaggatgtgggcagggccaaataagggaataaaagctggccatctgagccagcagcagcaaccagctggggtccccttccatgctgtggaagcttagttctttagctcttcacaataaatcttgctgctgctcactctttgggtctgcactacctttacgagctgtaacactcacttcgagggtctgcagcttcattactgaagtcggtgagaccacgaacccactggaaagaacaaacaactctggtgacaccacctttaagagctgtaacactcactgcaaaggtctgtggctttgctcctgaagtcagcgagaccatgaacccacaagacggaagaaactctggacacatctgaacatctgaaggaacaaattccagacacaccatctttaagaactgtaacactcactgtgagggtctggggcttcattcttgaagtcagcgagaccaagaacccactggaaggaataaattcccgacacactgagagtgtgtatgtgtgattccctggggttcagaagctcgtaatacaagaagctgtaatacaagcttctgaaccccagggaatcacacatacacactctcagggttctttctactctgtttcttagattcattataattgtctctaagaaggactcagagttttaaaaattgtttctccaatgttatgcagaggattacaaaagcagattttcagatttttttaataagaaattgtgattcaaggagtctaaggtgaagctcagggatgtgtattttaatgagtttcctagaagaatttgatacatattgtctgaggactaaattttgagaaaaactaccttagagaaacaaaaataacgtgatcttccctggggataaggattaattaaaccttaaaaacatcaaagcaatgcaacttctttctgggagattaagaaaagtttatgcttcacaggtaggatactctcacagaaggaagctgagaagttcattttgtaatttgtaagtgttattattgggtgttcacacacatgtgtgagatgtggctcccctggacatgttaccagcctgatgaggtaaagagactattaaaaatctgaagaactccaagataccattcttgctaaaagcaacacagaaaacaaaatgcggttacatctctagggtaccgcagtggacaccccagcagctaaataaaggctaaagataatatttggcaagaaccccttttcacaaagatcttcataatgatttgatatgaacatgccctatattagtccactttcatactgctatgaagaaatacctgagagtgggtaatttataaagaaaaagaggtttaatggactcacagttccacttggctgaggaggcctcacaatcatggcagaggcaaaggaggagcaaaggcacattttacatggtggcaggcaagagagcatgtgcaggggaatgcccttataaaaccatcagatcttgtgagacttttcactatcatgagaacagcatgggaaaaacctacccccataattcaattacctcccatgaggtccctcccataaacgtgtggattatgggaccttcaattcaagatgagatttgggtggggacacagcggaaccatatcatgccccaatgtgacataaaacaaggtcaagtgagacaaaaagctcattcattagtcccagggcctgccttgtgtttccaacataatggtccaggccaagatatgtcttcagatctttccgtccaccttctgtggacctgtcaagatcataatgcttgctctgtgcttcttgtcttgacctagatctccatccttctctcactcctgaacttttctacagagctttaattcttcagtaatctctcttacatattaacttgactgtaggatgttctccctctccttgccatacctcaatcctagttctccctgaggaaactaattcctctgtagtcctttcacgtgaactgcttattcctccaaatgctgtttatctcagggtctagatctggagttgtcaatgagttttacctctattcgctacttcaatgctctcaattccctcatcctactttaaagcttttgttcctttgagattcaccatctctagcacttcacgtattgagtattccccaactcatctcattctagagttttgatttttttttttaccctcccttctgtgaagtggtagactgataatgcccttaatgtcttcagtgatctctgtaccttttggtactcactttacttgaccacttttcagaattagatatggttgaccatattttccttcctgaaattcactcctctgggcctctaagtcacagggctatattttagtattccaggaccctcacttgggatcatttgatatcacctgccagatgagggaataaaaacaaaactaacaaaaaaactcaatcacgttaactagtttcttaaagttcccagtacgaataaggggcataatggaaacataaatctatggcaaacatgggatctttaccgctacattttatggacctcctgattttgaggagttcttaattagttcagtgataaacagaggccttgggaaggcagaaggtaacatggtgattctggaacctggaaatggcagttggatgttgaaagcaactagtgtttcagaagataaacctcactgacatcctccatactatgacctttgagcctcaagtgagactcttattacatccccaaagttttagtcagatgcctgaaataattatttttaccaaaagaataaaaaaaaatcggtacaacaaataacttcctgatcatgaagctgaattccttttactttagggccacttctcttgagtcagcaaacgttgtctttgtgttttttgttggtgtcttcatctaattatgcagcctcatgtttgactgtctccatcaaaatacattcaacattatttccctactctattgctacttctggaaaatacaaacttttgtgagtattctgattcaaaattattatgacaaatatgtctccataaaggattgctagtaacatgattagctttaaaatatggatatataaattgtaaccttcttttaaattaaataacacaactgatacaatttttaatcttcaaatgttccaatcatgttttttctttcctgccacaagagaatattaagtcgattaaaaacagatttttggctctatgctgagtagaaacttacctaatagtaacttatttagtgtccttgtgaatacagctttctaatatgccaccagggagtaaattcaactttgtgataatttggattattaggtatttaaaaaaataaaacctcagctagaattgtacttttaatacaaacaacattgctttatgttgtcagctccctaaggagagttactctttttttgttggaagtagtttttccatttacataatttatgttcagaaaaagaatttcagataatgataatgtcataaaaggaaaggttattatctatatctatgtaaaaatgtgatgagaggtacattttgatttgaggagaatgaaagattggagctctgtgatgcttttgaataaagtatatttgattatttcctttcttgtttagtccaactgtggtttaggaggactcctgcaagaagacaggtgcataaagatacttatcaactagataagagtccattcaacctggaggcttattttacttttttatattgctattgtagaaatgcagttaagtgcaaggtctactgatggagatatcatgaaatgataaaaaatttatatttgttctcactattcttattatctttatatataaacacatagataaaacacaatttcataacagaaaaggaaattgactttttttccgcttttaattctgtattgaaaatatcttcatcataaaacacactttggcccatgcaatttgatacctacttgcaaatccttatcagcaacatacttttagatctttggatccctaaaactgttactatcaaagacatattctctcacttaaacctgcttatatacatgccttggttgagtattaattttcttttaccttatttgtaagacagtattaaagagaatcactatataaatcaaagttattattttggtaaactgattattctttatattgtatgcaatagcaaaaagaaaaataagcaaatatcctcccaatttaagggagaatgaaaatgaatccttaggaagagaggtgaaaaaataatggttttattaaaataatttacaatcattcattgaagctgagctgtaccttttatataagtttttctgtataaatttcaacgaatccttctccacatcttctgtggtaaagaaagcattagtgttgtcatttccatggaaggcagtaaagccgagctgctgggatgagttgcccaaggttacacacacgtggtaaacaacccaagtcttctggttccaacacaaagtgttctttttattaaccacagctgcaatctcaccatttacattttggagaataattggaaataattggattattattggcatatcttacatgtacatagaactctgattctgcatgtttttccacctttaaaaccaagcagtaaagtatgttccccttttctggggatatttttggattaagtaatcttaagaaaacaagtatcctaaaaaaatatgataataagaattgctggttgacttttattcttgccacaggcagcagtttggcaggtgcatgtaagtcttgatgagactgtcttattaaattataggaccaattagtgcacctagatatattttgactggttctatacctatggcacctataaattataattggctggtgatggttgtgacttaactatacctggaactgataatcatatgttataatttcatataaatgataaaaataattataactcccaaatcttggtgattgatttagcaatagtcttttagaagtaccgtaataccttacctaagagattttaataatcttgaattgattcaatgagatatttcttcaagtagttctaaaaaatgcatagatttcattatctttactatgctgtgacaagtaaaacattttccgtccatgagtttttggagatacgaattctgtcatggaattacagactggagttttacgatcgctgagaaaataatcattaaagataaatctattaaatcctaataaatagacaagtcatctaagctttagcatctacagttatgtggggtggtaatggttcaatctttcacttttgttaagaagctgaaatgtttttcaaagatattgaatgttaacagcaaaagataaattcttcatgttgacacagtgtttcaaaagaagtgtcgatgttatacttatagcaggtgaattactctttaaaaatctgttgtctgcattcctgtgtgtggcttcctgatcctctctagtttacagcttacaagtatactacctgtcatcgttcagaaggcttgtttctagtattcttggctgaatattctgtgtgccttaaatttttaaagaccaatatggatgtggcatagacaggtgattctcaaaggttagcattcaccaaaattgcctgatgggcttgttgacatacagtttgctacaacctaccccccagagtatgagacagtagatctggagtagggcctaacaaataatatttccaccaagtactagatgatgccgctggtctagagcttttgataaccactggtctacagtaacagttaatagctggttctctagagacggactgcctaaattaaaatttatttctgtcacttaatagttggtttacattcagtgagctgcttttaactctgtgatttagcttcctcatctgtacaatgagtctcataccagtacccagttcatagaactattctaagatagtacctggaacagagtgagcactcaacaacagtcagatattatcattcttttcagagatccatttgactctaagctcatgatagccaataaaaaaaattatcttatttttttttaataaacatactgtgttcatggtaaggaatactgaatatagggcagataatacctggagtaatgtatttaacttttgcaaacatatttttagaaaggctttgatagtctggaatgagtccagggaaggtaaagagacttaaaattctgccacatgagggaggggtagagacattttttgagaagggagtctgtattagtgacaccctaactgtgttagaatactcaggcacttatcattgcctgaacacagatatgctattcagtgctttttaaagaatttttgccttaatataaagaacattatatcaattatatttttccaaaagaatggcttactctgtgtgtttgtaaattccttgttatttactgtgtttaaaaaagaaatgagcaattttttattataaagtttggaaaactatgtcctatcttgctaagaaagctgagttagcctctcttttagggactttctatatctaaaatactccttggtcttatgaacttgcttttacatttgaccccatagattatgtttccaaatgtcagactatatttaaagtctatgcaattatgatggagtaaaatgtgacacaaaatctgttaattttattcagtaaattctgcctgcttggccccacaagaagtggaatcttgattatgtcagtcctgttgcttaaatactagtctgggactattatactgagctgtgacaaattggactgtccataatttccaatcatgcctgattccactattgttgtatgaagatggactgcactatcttagtgcaaccacttggctcaccacaatgcaaagctgctgttgcggcaaagacaacaagaaggcctgctggcaaataggctacttgaatcagacagtaaagcgagaagcaaggagtaatggttatgaagataactatcctcagggaatattttttgctgtgaagcgtctatgagtgtttggtgcataatccattcagtttacttaatgcttttgccaaatcatgccctcatgtttctgtttccctccagacaaatgaatatatgtgaaatgacaaaactttaggtgatatgtggcatggagatattaaacaataaactacagtgaaataaaagatttagaagaatcttcagcaaaatcactgttataaaagaaaaggcatggagttggatagacctgattcaatgccacttcttttccttttttatttatttatttttttgaggcagagttttgcttttgttgtccaggctggagtgcaatggcacaacctcggctcactgcaacctccgcctcctgctttcaagggattctcctgcctcagcctcccaagtagttgggattacaggcatgtgtcaccacgccaggctaattttgtatttttagtagagacgggtttctccatgtttgtcaagctggtctcgaactcctgacgtgaggtgatccgcccacctcagcctctcaaagtgctgggattacaggcgtgagccaccgcaaccgcctaatgccacttcatttactaattcctgtttggactttagcaaatttcagtagggcttggtttcttatccataaaatggataattatgccttaagcttgttgttgttttgtttgtaaactgcggggaaagatctccatgaactagggaatgacatgtcctctttgataagcagactttttacatccagttatacaagtcaagttatacaaagcataacttgacagtcacatgtagtaaaagacagaatggcttataaacatgcaacgcttttcttgaaccttaattgaatgcatttagcatctaaggaaagaacaagtctttggacttgttctaaggaaagaacacatggacactcaggtactgttcaggaaccaggaagtgaaatacaatacaacatcaacatcgactactctgttgccattttaaaactatgcctttggctttaaacattaagtgttttgttgttgttttaattcaatgttcaacagataccaatctgtggaaaattatttttcctgtttaagactagttatctgagagagttccagtctctattatggttatataacatttgtcattataaattgaggcttgtggatttggttagtgaaaggcaacctgagagactaattccctcgcagtgtgtattaaaagatttctgagcctgcatggatgagagccaaaccttgcatactcaccagcatgatccattttaccctacgagaccttttgggagacagccggccagtttgttttgaagtaaatgcccctggacaccaactttactgcatgcagaaattttgaaacatcttaatctcccttgttgtgaagtgttcagatttagaggcaatgtaagggaattgactataacttaatggacaagtctttactaaatgtaacacataattagatgtagacttctgaattcaaaataggttttctgaaaacctattgtatctgggatatgttattgaatgagtaattcagtgggagttacgaagggactgtaaaaatgtatttgttaaatggtgagcatatcataataaaaagtagaccatatttatggaatgcaccgtgtatgtcaggcattatatatgacttttttttctttggagacggagtctcgctctgtcgcccaggctggagtgcagtggcgcgatctcagctcactgcaatgcaacctccgcctcctgggttcacaccattctcctgcctcagtctccctagtagctgggactacaggtgcctgccaccacgcccggctgatttttcgtatttttactagagatagggtttcactgtgttagccaggatggtctcaatctcctgaccttgtgatctgcccgccttggcctcccaaagtgctgggattacaggcgtgagccaccacgcccggccgtatatgacctcttaaccctcaaaacatcccttggaagtaagttatcttagtctccctttaggtagctgggtcatagtaaggtgaaaataactctcacaagtttcacagctgttgagtgctttgcccagagagtctggcagagaccctgtgctgaaaacactctggaatactgtggtatgttagaagatgttgcagagatacaacttgtttcttcccaacatctatcataccacttttgcatgctaagaggacatctgtaagattgagaatgcaaacaaagaaacaaaaaacccaaaaacaacttaactgtaatctccctttttccttaggtgtaacttttctccttaggtgtgactaaattctgactatgataataaaagttgtaaagctggaattcaggaatgtcacattaaaggaagaataggtagtttgtgaaataattgtattatgtgtttcgttactcttcatcctctttcccttttggtggtaatgtaggtataaagtttggagccccagcaatcattttggatcttgggatgacctcaaggatggaagtcacatgctagtatgcttatgcagataaagagttggtctttgatgaaatgcaagctgcagtatcaagtttggacatttttcatctggaccactttttatttgatgtaaacccttgtgcatttaagccagttacattttgaattttctgttataggtaatcaaatacgatcctaacagctaacaagaaagagaaggcagcagtaagagatagaatatttttaaccatgtttttatattaaaaatggaaacgggcagcagtggtgatctttttcatatccctccgcttcactcatctttatcttctttcatgggtatctctgtcttaatgcgacttatgagtttgctagcacttcagcatagtttcataaaggcaggatgaacctgctgtgggattttaaatgatgtaaccgataatgtcccctaaatggaaaacttgtgaaaatgagaggaagtactatgaataactataattgtctaaagggtgtaagccagggctgctctagatatacctggatgtcaagtcaccctaggtttaatgatagaaagactgaagaaaaagaggaaaagaaagaaaggtactgtaatagaaaaacgtggactagagaaatagagaatgactgattttaaaaaatacatctaatttctattctaaggtgcttcacagtttcatgaatcgtaagtgtaataaagattagatactgataatggtgcttgctatgattattattacaaggatgatcccaattatgatctataaagcctgttcagcatgaacaccaggtttcaaagggaggtgatgaaaaaacaagacctaaaaggaatctcagatttctgccagtcctttgcaggaacaatgcatcaggggctgatagaaataagtaagtctgctagttacaatttcttttcccagaaaaccataggcgatctaggtaagctttaaacagacatgaaattctagttgatgttcagaccttctatgaccgctagaatttggagtttcagatttttatggctaaaacgtggggttttctctgtggtttacaatagcatacacttaagcaacaacatgaacaaacatacctgtttttctctgaatcctcctgaattaatgctgaacaaccaccgaggcagaaaataggagcagatacatatgaagaagaattcttagagtattagaagagtatggtgatacagcagtttcttgagggtggacttaaaaacaataacgagaaacccagtgggaatgagaaaaaataatagactggttaatgacagagctaactaaagaacaacaacaacaaaaagaaaaacaaataaatgtagccattatatcaaaggacagagaaccacaatataaaaactaaatggggaaaaaactagtaataaaatgtctcctctcaggtgggcacaagctcatgatagaaagtcagtaaaattttttgagtgtattgtaattgatgattcagagcaagaaaaaaaaaaaagcctttttcttccctagtcttctaaatgaatcttcccattgtgatctcaacaaaaggccaaaataattaaaaaggagtaagttatgtgtgcataacaaccgtggaaaaacaggtacccaacaatgaagaaaagcaatgcaactgagaacaatagtgctttcaggataaatggcttcccagaagcttaatttccaatgagaaaaaaatgttctgaaaattgtacccaggctgtcacagaacacaacatttagatggtctgttattctggggagattagccatagataaagagaaacctattttcaacttttaatttttctccctgtcacaatgtgctttctggcttattttgtttggctttaagtgagacaaaaatattcttctacttataaataacatactggtggcaggtgattgaactccaacctagacatatattgctgagagaaatgaacaaaagcacttgtggaaaggagaaaagcagaaattaagtttactattttatatgttgcttttccaaatttttaatccttagcttttaaattattaagaaatacataatgtgagaaaggataacaacgtctaaagccacttatttaaaaaatccttttaaataactttctggatagtaaaacgagtcaaatttatttttaactatttcacttacaaattttaggggtttttgttactcacaacagataaatctatacaccaccacttcctcccaataaattttttcagttttctttttttttggattatttttgttatatttcatgtactaattgatacatatgaaagagaataagaagttgtatatgtaacagaacacaatttttaaaatgaatatcaaaccagtacccaacctaagagccagaattattgtatttccccgagtgttcttcattccccagctccatgaacagataatcactgtcctagatttcatgttttaatcttgtactatttctgaaaaacacaattttattgcatatatgttttttctctatgtaaaacattattagttttgcttgctcttaatttgtatagaaattgaatcacacttcatttggtcttctaaattagattttttttttgctctgtattgcaaagaatcacacgcattgtatgtagctgtagaaccttccttttcactgctatgaaatcccatcacatacacagagtgcaatgtgttaatttttccgttgaataatatttttgtttttgtttttatttgttatgaacaaagctgctacggccattcttgtgcggaactccattttcacatgcaaaactagttctatattttcagcggataaatatagcattggaaatttattttaatacagtaggtgaatattcaacttgaaggataattccatcttgttttccaacatggttatatcaatttataccttcaataaagggtttaggagctctaattgatttatatcatttccaacacttggtattttccgatttaattctggaaatgtaataggtataaaactgtatttcaacgccattttagtttgcatttcctgattactaatgcagttgaatattttatccatctatattttcttgataattcctcttttatatgtccatgtcttttgcaaatttacacatcagattgttttcaatcgacttgttttttttttttttttcattcagaatggtttattactcacgtattgagcagtgtggctcccaaccagatccaaaagtggcttgagaaagccagaaaaggagactggctttgggcttttatgttggtcagggtgtggctgagctgaggatgccatccagcaagcctgccctttgtacgtgaacttcccgcctgctgatgccaatggagggaacacttggactttcttaccagcttgcccacatggagggtaagaggaaaagtgggagtggtggggttcaaagttgtctccagtgaaacatcaaaattagagtcacactcataagttataaggtaggaacccaacttcactgtatccatgtggttagccaattgcctttgtgccattcactgcatagtcctttctttccccggggttctgaatagaatatctctgttctataccaagttttatgtctgagtgggtctgtttttgtaacatttttaaaatttgttcatgctggtgccattgtattcactattatctaaattataataaatattgatattaggtagggtaagttcctaccaacatttttttcttcttcatcaatactttgtttactatttgcccttactctttcatgcaaattttagaatcagtttgtcaagttatgtggatgaaaaaagcttttgtttttatattacatcaaagttatgaatcagttttgggaaaattggcatacataaaacattgagatagcctatctaattaacaggcataaagtttcacatcagcaagttgcataagctctagagatcttccaatgtacagctattgtacctatagttaacaatactatattgtatacttaaaaatttaacagggtagatttcaggttaagtgttttacaacaataaacttttttatttatttatttatttagtattatactttaagttttagggtacatgtgcacaacgtgcaggttagttacatatgtatacatgtgccatgctggtgccctgcacccactaactcgtcatctagcattaggtaaatctcccaatgctatccctcccccatacccccaccccacaacagtccccagagtgtgatgttccccttcctgtgtccatgtgttctcattgttcaattcccccctatgagtgagaatatacggtgtttggttttttgttcttgcgatagtttactgagaatgatgatttccaatttcatccatgtccctacaaaggacatgaactcatcattttttatggctgcatagtattccatggtgtatatgtgccacattttcttaatccagtctatcattgttggacatttaggttggttccacgtctttgctattgtgaataatgccgcaataaacatacgtgtgcatgtgtctttatagcagcatgatttatagtcctttgggtatatacccagtaatgggatggctgggtcaaatggtatttctagttctagatccctgaggaatcgccacactgacttccactatggttgaactagtttacagtcccaccaacagtgtaaaagtgttcctatttctccacatcctctccaggacctgttgtttcctgactttttaatgattgccattctaactggtgggaaatggtatctcattgtggttttgatttgcatttctctgatggccagtgatgatgagcattttttcatgtgttttttggctgcataaatgtcttcttttgagaagtgtctgttcatgtccttcgcccactttttgatgggattgtttgtttttttcttgtaaatttgtttgagttcattgtagattctggatattagccctttgtcagatgagtaggttgcaaaaattttctcccattttgtaggttgcctgttcactctgatggtagtttcttttgctgtgcagaagctctttagttgaattagatcccatttgtcaattttggcttttgttgccattgcttttggtgttttagacatgaagtctttgcccatgcctatgtcctgaacggtaatgcctaggttttcttctgggtttttatggttttaggtctaacgtttaagtctttaatccatcttgaattgatttttgtataaggtgtaaggaagggatccagtttcagctttctacatatggctagccagttttcccagcaccatttattacatagggaatcctttccccattgcttgtttttctcaggtttgtgaaagatcagatagttgtagatatgcggcgttatttctgagggctctgttctgttccattgatctatatctctgttttggtaccagtaccatgctgttttggttactgtagccttgtagtatagtttgaagtcaggtagtgtgatgcctccagctttgttcttttgcctcaggattgacttggcgatgtgggctcttttttggttccatatgaactttaaagtagtttttccaattctgtgaagaaagtcattggtagcttgatggggatggcattgaatctgtaaattaccgtgggcagtatggccattttcatgatattgattcttcctacccatgagcatggaatgttcttccatttgtttttatcctcttttgtttccttgagaagtggtttgtagttctccttgaagaggtccttcacatcccttgtaagttggattcctaggtattttattctctttgaagcaattgtgaatgggagttcactcatgatttggctctctgtttgtctgttgttggtgtataagaatgcttgtgatttttgtacattgattttgtatcctgagactttgctgaagttgcttatcagcttaaggagattttgggctgagacaatggggttttctagatatacaatcatgtcatctgcaaacagggacaatttgacttcctcttttcctaattgaataccctttatttccctctcctgcctaattgccctggccagaacttccaacactatgttgaataggagtggtgagagagggcatccctgtcttgtgccagttttcaaaggtaatgcttccagtttttgcccattcagtatgatattggctgtgggtttgtcatagatagctcttattattttgagatatgtcccatcaatacctagtttattgagagtttttagcatgaagggttgttgaattttgtcaaaggccttttctgcatctattgaaataatcgtgtggtttttgtctttggttctgtttatatgctggattacatttactgatttgcgtatattgaaccaggcttgcatcccagggatgaggcccacttgatcatggtggataagctttttgatgtgctgctggattcggtttgccagtattttactgaggatttttgcatcaatgttcatcaaggatattggtctaaaattctcttttttggttgtgtctctgcccggctttggtatcaggatgatgctggcctcataaaatgagttagggaggattccctctttttctattgattggaatagtttcagaaggaatggtaccagttcctccttgtacctctggtagaattcggctgtgaatccatctggtcgtggactctttttggttggtaagctattgattattgccacaatttcagatcctgttattggtctattcagagattcaacttcttcctggtttagtcttgggagggtgtatgtgtcgaggaatttatccctttcttctagattttctagtttatttgcatagaggtgtttgtagtattctctgatggtagtttgtatttctgtgggatcggtggtgatatcccctttatcattttttattgcgtctatttgattcttctctctttttttctttattagtcttgctagcggtctatcaattctgttaatcctttcaaaaaaccagctcctggattcgttaattttttgaagggttttttgtgtctctatttccttcagttctgctctgattttagttatttcttaccttttgctagcttttgaatgtgtttgctcttgcttttctagttcttttaattgtgatgttacggtgtcaattttggatctttcctgctttctcttgtgggcatttagtgctataaatttccctctacacactgctttgaatgtgtcccagagattctggtatgttgtgtctttgttctcgttggtttcaaagaacatctttatttctgccttcattttgttatgtatccagtagtcattcaggagcaggttgttcagtttccatgtagttgactggttttgagtgagattcttaatcctgagttctagtttgattgcactgtggtctgagagatagtttgttataatctctgttcttttacatttgctgaggagagctttacttccaagtatgtggtcaattttggaataggtgtggtgtggtgctgaaaaaaatgtatattctgttgatttggggtggagagttctgtagatgtctattaggtccacttggtgcagagctgagttcaattcctgggtatccttgttgactttctgtctcgttgatctgtctaatgttgacagtggagtgttaaagtctcccattattaatgtgtgggagtctaagtctctttgtaggtcactcaggacttgctttatgaatctgggtgctcctgtattgggtgcatatatatttaggatagttagctcttcttgttgaattgatccctttaccattatgaaatggccttctttgtctcttttgatctttgttggtttcaagtctgttttatcagagactaggattgcaacccctgcctttttttgttttccattggcttggtagatcttcctccatccttttattttgagcctatgtgtgtctctgcccgtgagatgggtttcctgaatacagcgcactgatgggtcttgactctttatccaatttgccagtctgtgtcttttaattggagcatttagtccatttacatttaaagttaatattgttatgtgtgaatttgatcctgtcattatgatgttagctggttattttgctcgttagttgatgcagtttcttcctagtctcgatggtctttacattttggcatgattttgcagcggctggtaccggttgttcctttccatgtttagtgcttccttcaggagctgttttagggcaggcctggtggtgacaaaatctctcagcatttgcttgtctgtaaagtgttttatttctccttcacttatgaagcttattttggctggatatgaaattctgggttgaaaattctttcctttaagaatgttgaatattggcccccactctcttctggcttgtagagttcctgccaagagatctgctgttagtctgatgggcttccctttgagggtaacccaacctttctctctggctgcccttaacattttttccttcatttcaactttggtgaatctgacaattatgtgtcttggtgttgctcttcttgaggagtatctttgtggtgaacaataaacttttttaaaaaaaaatatctattaatatagaaattctcatctgcatggattttaatatcttcaaataagctacatcacatttttgcacaaattttaattggcttcttcctacttatagtttcagctgctactataaaagcaacttaaaaacttcatttgtactacctgccgctgtgtttaaaaattcatttttatgtattttccttaaggcacttgttataaattatttaacaactcagcaatattgagctatctttttatgcttacctctgtttaataagtgatggaatccttgccaatgagagacattggttttatttggaagagggaatataaccagtcttcaagtgttattattgctccttggtagcagagacctggtgtgggctttacagatgttatattttgtgttggattctttacttactgtatacatacttttttttactccaaaaaggtttttagagacaggggtctcactgtgttgtccaggctgggtttgaacccctggcctcaagcaatcctgcctcagccttctgtgtagctgggattatgggcatgagccactatgcatagcagtgcttactgttttaaattacttgcactactatcacactaaaggcagctgtgataattgttggtggtttcctttgattttcttttgttattacaaattgcagactctcttgattcttgtagtaaacttgagagttcagagtgaattttcttgtctttcgtcctaccacccctttaaaatactaattatttacctctgtaataaagtatctcatacttgaaatgcatagtttcttctaatattttatgaccaacattttattaatacaacaatccaagttataccctattatttttctgttttttagtttttcatgtaagcaaatatataatatgcaagtcataacagttttttttttttttaaatatggctctctaattcttaagtcatcaatttatttttcttatcttagtgcactggctaggtcttccagtataataataaacagaattggtggcaattattcttttatgattttaaaaagaattctacttacatttcataaataagaattttgtatactgtgatatattagtagaagtcctttaccccttttccaggataattgtgtaacaatgtattttttggtttgttaataattttattatcgatgggtaatacctttttcaaaggtttttgttggtcggtttgtttttaggaaataagatttaaattgaaattcaatttatttaaagttataggtcaacataggttaactaacctataatgaaacagcctgatatgctctataacttttagagaaaataaatggcagtttattttttctggaactgctttcatttaaattatatatatttttaatttatacataaattatatataattcatatattttgtatatattttatataatattttatatattttttaaaatttctattttctgacagaaactaattcattttaaatttctgctgtagtgttacttttcttcaatttcctgtctaatattttttgtgacttctctatttcttggtttatctatattattaagcttcaaaaatttgtcttcattgctccttttcatctttaatggttattttaaatttcaattaagtctgctttgattattggtttctttgttttctgtgtttttttttctgtttctccaactattttttaaagattgattacttggctagtcgtggtggctcacacctgtgaacccaacactttgagaagctacagagggaggatcccgtgtgctcaggagttcaagaccagcctgggcaacatagtgatatcctgtctcaaaaaaaaaaaaaaaagttggattatttcctttccctcaaatttgtacgttcttttgtctaatgttttagtttttatatctttaaacttcatactttcaattcattacagctaggtatacacaatatttatttctattttcaaacatgttaccgtaatattttctcactctctatgcatgtcagacctttctggtatcactgtcttcctccggagacatatgctttagaagtccctttagtgaaggtccatttctgccatttcttgtttttttctttattttaatatcccaaaatgagtttattttactgtcatttataaacaataatttcttgtcaggttgtaagttaactttaaaaaaaatccctttgatgatttcactgtcttcttgcttaatgcttgccattgaaaagtcagtaattttaagttatatgcattttttttttctccctggatgcctgtaaaaaagaaattgtgtctgcttcttctcagattcagggatggcacaggcttggagctaatttagtccactttgtgggcaatgtcttaatatgggagttcagggttatgtggctcagtcagcccagcttgtcccgggcctgaagatgactactgatctcggggctttttgcatccccttgagtctttaagctcatcttccccagctccagtttcagcctgttatttgtttaacacagtcatttactttattgtttctggtggctttttttttttgtaggtgattttctcacatttcatttactatatattgaaaatattgttactttaaaatctaggatctagttgtttgatattgtagaggttctcagagtacctacatctctgtacaaccagaagcaaatgttctttcatgaatacagttttattctaacacagtcacatgattaatttatgtattgtctaaacactataattatagatttaagtagttgtaatataaagcgtacggcctacagagcctaaaatatttactatgtgatcctttacagacaattctttgccaacccttgacagttctacatgactaaaaactaatttacatctgctccattgtctatgcttaacatttactgcatctttgtatcaattaacatgctttcagttgcacgtaatagtcccaattcatgacatttccagatttaataaactgattaattcagcaacttacacaacattattaaagacagtttatttgatttcctgaatcatcctcagtgtgctagtctttgttctccagttcatggtagtaagatggctgctagatgatcatgcagacacagtaggaagagatcatttcctaatgttaatctttttgtgtatcagccaggaaaagcctttcctgaacccatccctctgcacattttccctcacatctaagatagtgttatctgttcatacctaaacctgccactggctagaagagtaagtgtcacgattaatgtagaagtcaagtttctgctgcaataatggcatgaagcaaacattcccagtatttcaatggcttctattgtgaaatatttctcctcacaggtctgcaggtcagataatatagctttttctttagaatacaggtcaggctaaggtcctttccacattccctctctttgaaactgttgctgattgggttatgcttttctaatgggggcagataggatctccaagagggcaaataaaaccacccaggcacatttaaggccctcgtagggcctggcatacattatatcagctctccttcattggccaaggcaagtcacacaagttcagtattagtataggaaaaaagacctcttaagggggaagcataaagtcacacgataaatggtatggttatacaatcctattacagggagggataaatgattgaaaaccataatcaatctttacgactagctcaaataaatcaaaattttgctcttgaattgagtagaggatcaaactcccagaaatattaccactacttgatatgatcacgaaataagttttgttatcaaaagataaagaatggatgcagctttagtcttcatttgcttcattccaagtgctgttgcaatatttcccgtacctgaggaaactcaaagggatggctttaatgctatcagaaatctgagtccttagagtaagaaaataaatacaaaatattcaaaaattgcttgtactaaatagcgcatattgacaacaatagtcaaacataatatgccactattttctccataaacaaaagtcccccaaataaatcgcatctctccagtcttgtcacttagaaatagtaacttaaatattttccatttaaaatagtctagagactcaaatttcttactgttgtcatctttcacacatgaaaactgtttcaattttttttttctaatagtattgcttaaaacactaatttcttcctactttttttttttctttttttgttttgagacggaatctcactctgtcgcccaggctggagtgcagtggtgggatcttggctcactgcaacctctgcctcccgggttcagtgggactactgagtagctgggactacagacgcccgccaccatgcctggctaattttttgtatttttagtagagactgggtttcaccgtgttagccaggatggtctcgatctcctgacctcgtgatccgcccgcctcggcctcccaaagtgctgggattacaggcatgagccactgtgcccggcctcttcctactttttacaaactgtattttttaatcaatgatataaaaactgacttcttttgtataagttactcttcttactatttttctgatatgattgtcaaaagacatgatcttttatgacactgaaccttgaggacatatttattaacctttttccttagaagttaataaagggaggttactttccagtagttgatcttatttttaagatttgctataagttgtaaagagtcattcaaaataaatcatttttcaacccatccctccagtcataccgataagaaaggcatttttttcgatcatgtcttgttaatgagcacattctttggggatgcctcggtcctaattacaagtgggcaggcagccatgagtgcaggctggaagacctggtgagcggcaggccagggaaagcatgcggtggtgctgggggcacccgtgcgggacagaactggagctgactctaaggctccagggagcaatggtaagctgcaaaatggtactaagggaagcacacagaaaattaccagagaaagacagatggttgggatgtccaaagctaagaagaaatctctaaaatgactagtgagagggaaacggtagatggagtccctgagataaaaaataaataataaactaagtgtctgcacgaggcaaagcaacagctagatgtcacagtgccgaatggcaggcaagtcctccaacagcctaattcgtaagggtacagctgccaaggagggtcaaaccaaagtaaactctcaaacctaagtattaccagttagcatcctatcttagggtcacaagtgaaaatttcaagggttgggaaagtgattgttattattgtcagttctccctctgttttgtgtaggtgaactcattgttcaaacaatactgagagaatatgcagacagtggtatacaaagttgaagaaaaacattttgaagatatttatcttttgaaaggtatttctacctagacccaactcggttaagctgttaatgcaacttctatgtatcaggttttcctctggaatttaacagcctcttattttctccaaggacctttggctgttaaacagtgttcatgtaagcccacaccactggccagaagaggcatgctcagaaatcaccattgaaagccccaaacgtcatcaaggaaaaccagtaaacataagaaaagttagggatgaaagacacctggtcagtttttctcactcccatgccacgtcagatttacaatatggattacgtcagagctattcatctggattacggtgagtgtcagtttgctatgtgctaagtaccacaacctgggtatcttcaacaacaaattgcctcaaagttctggaagctgaaagtctataatcactatgtcagcaggtttggttcctttgggggcttcaaagaagattctcttctattccactctcatagctttcaatggtttgttagcatctttctttgaaatcctttggcttgtagatgtagcacccctacatctctgccttcatcttatttggtgttcttcccgtgcatgcgtctctgcgtgcacctttctgctttttataaggataccaatcgtattggaaagacctaccctaatgacctcactttaccttgattgtgcctgtaaatatcctatttctaaataaggtcatattctaaaataccgggagttaggattttaatacatctttatggagggcacagttcaactcagaatgggtgcaagaagctgaggaatatgtcaaatacaatttattgcatgtcttttagagatcacttccattgtccatgtattaatggtgagaaaattgaggtcgagacgagagaaattacttgctcaagaaggatcattagaatggtcataggtgggtctaggccggaagcaagtctcttgatctccagcacgatgcttttgaagcttcattgtaaataccactaaacattatttaccctttagattagtgcttcagaatttttgggtcacatagtccctttgagactgtgaaggagtctctgaaccctctcctcggaaaatggctgtgaacagaaaccaccccagtcttatacaactttcaaggacatctttgaaccctatctctaactatcctctctccagattttctttagtcaagtcatcttaagtatgttttgattcctgagaaaattgcttaaaatgctataaaattgtctgaaatagcaagaagaacatgttgacttttggcttggaaaaaaatgcatacttatccagagtgggaaatttcccccttatggcctttgcactgatcataagtgagaagtggcagaaagaaagggactgtgttcaacaacgtgattctcatcacatgccagctccttcagctttctgtttaacagttgggcaggtaggcttgcctagggttttgcattgatgcactgtaaacatattcgtcttagttacgaaactatagaaagcatttaaaataaaaataaacctctttccaatttgcattgcacatagtggattaatttgtccaaagtccatgctatttaaatgaagtttacattttccaaatgtttaacaatatgaaaacgaatatttcacttgaaagtctgaaagcacaccattagagtcattcagatacatggatgttacatctggaattttattaaaattcaacgtttttggctgctgtcctctggctctgagcattggccccatcctgttgtcatagctctcatctgacttgttcctccacaggaactttcctgctttggaagcctggggtacacgatctaaggcctaaaagctgcttgctttcagctaggactccttccaagtcctagcatgtcaatatgcttttacaaagatcgctatatcatggcttacttttttatcattgcaacaacaatgatagttaaaaacagtgttcagagcaaggtttgctcttttcagcagtttcttctctccaaattgcttcttccaattaacaaaaaggagttgaaaaccccatttcctgcagccacctgtggcctccctttctttaggataaatttctctggcacaatcaagagttcctgtaagctcctgggttctttttgaatggaaattaggtaaaatgaattttgattctttttcagatctggggtagtggtgggtgttggatgtaaaattccctgattatatttcaatcatcgtctcacatcttttttataacacaacctctgatacttttaaattcaagatattgacatcattttgccggtgaaacagatgctttggcactgaatttggaagtatataccttgggtgatactttcacatctagcggagattaaatacggatattgacaaggtggcaattatcatttgaactcagacacggaggctcactttgcagctaatttggcacagaaaaaaattgttctaaacaatcaaaattttaaccagaagtttcaatatgtatttcacattctttagagggcttgtgaaagcctatataatttgaactaccctgacttttcagtttcttccttcgtctaactctctaagctgctagaacaaccacagtccatactgaactttgtgcacacggagatactggatgaacaacggacaatgtccagaccatctctggaaacagaaccctgacccacaccccttcagcaacctgccaggaaggccaagccacaatctctgtggcaattggctcaggacggtaaggacttgctcaaaaactgccagcttctctatttttttgcctctgtttttaactcaggaccaacaagagatagctaaatatgctcaccaatcagatgagaatttttacatataggctctgtcctgtgtttgtttaaaaccttggtttttccttggattacagtgtttccataattctgtttttttaacctatctatagcttctattacattacattatatacaacttttgcgtttttcttaaatgtgtatatttttaatacttatgtttcctaggatataaaaaattttgaattttcacatgtacgtggcattcttctttccatagctggcaggacttcatctcccattgcacacctcttcgaatgttgaacactgtctgacacacggttttagttgccttgattatatatgcccaataccaccctatcatttgctattcgattcctgacttttgcttgaatttcctatgtttacttttgctatgttgtcttgataacagtattctctcattctcaactgaatttcttcccagtaaggtattgtggttatctttgaacagtgtttctcaaaccttaatattagtatgacccacctttggatattgttaaaatgaatatgcgaattcattacttctgggttaggttcacattctgaatttctcctattgcccaactcccaatgctcttggcccacaaaatgcactttgatacattttgttttccaaatctgagagattataaaaaatttctgaggatatagatacatcaatgtctatatatctacatctacatacacacacacatactacacaggcagttgttcctctatatccgtgggttccccaaccaaggactcaaacaaccacagagaaaatgttgttaggcctagggcagttgtatctgtactggacgtctactgacttattttttgtcattattccctaaaaaatacagcataacaactagagtcaccccttggtacatgtggagcattagttctaagataccccacccctgtggtcaagtctctaatataaaatggtatagtatttgcatttaacctatgcacattctcttgtatactttaaatcacctctagatcacttataatagcaaatacaatgtaagtgctatgtaaatagttgttactctgtatttttaaatttgtattattctttgttttattgctattttttactttattctttcaaatatttttgatctgtggttggttgaatttgcagatgtggaactggaggttatggagagcctaacttctttcttttttttttttcttgagatggagtctcgctctgtcaccaggctggagtgcagtggtgcgatctcggctcactgcaacctctgcctcacgggttccagcgattctcctgcctcagcctcccgagtagctgggactacaggcacctgccaccacgttaagctaatttttgtatttttagtagagacggggtttcaccatgttggccaggatggtgtccatctcttgacttcatgatccgcccgccttggcctcccaaagtgctgggagtacaagtgtgagctaccacggcctaccttatttctacagcatttacacagatttggatcagtccattccaactcatcccgctgactgagttagccatgcttatcttgtcatcatccccgcactctatactcacccacatgaagacacacgcagtcgtgtataaccattgcatttggtggtgtgacaggctctggcttatggttgattttgaattatattattttttaaaactattttagaatatgtctattttctaaatgtagcactttacggcattttattatgtaaaacacgtgaaggtcagtgaaaatattgaggtcttatgcagccaaggttagaatttaaaaggtctatatgtgaatctgtcattgtacttttagaaaataaaggtgaaggctgggtgcagtggcttacacctgtaatcccaccactttgggaggccaaagcagtgggatcgcttgagcccaggggttcaggatcagatggggcaacatagtgagtccccatctctacaaaaaaaccccaaaattagctggatgtggtggtgtgtctatagtcccaactatgtgggaggctgaggttggagtattgattgagcccaagaagtcgaggttgtagtgagccgagattgcaccgtgctctccagcctgtgtgacagagtgagactcttctgtctcaaaaaaaagaaaaaaaaaattttttttttggtcaaattcatattctgaggtttagtcattaatgtgaatgggagtaagatttattcaacatttactttgtgaaagatacattaggcttacttaacttcatgaattttaaacaataatttgttgagtacctaaatctgagaaattgtgacattagatttccatgcagcatgcagtgtttttaaaagtttttaatacctagttttatttttactattaatgctatgaattaatatattttattgttgcagttagtaacaaacttcttaaattttttaaataacattcttttatacattcagacaaacaattggctttaagaaaattataataaacatctgcaaattagattcaaatataagaaattatttcaccatatctaattgtcttatctcaatgtgtcatttatagttcaagaaactgtgactcaaacagattgtagtttttgtctaggatcattttccaacagttgaaataagagtttaacctgggtccttcgatgccaaagctggggctgtaatcagtatggtccaagatttttacaatagccctacagaaattctaattagttaacagatatgccataagtaattttatacaatgtagacaaaactatctgatactaaaaatgtggaagaacaaatgactattaattgtaatctgagattgcaagtgaagaatagatcacttttattctgatgtttttaaaacttccaataattttcattttttcattttatgatactcttatcaaacacatctgagctaaacaaacttgattcttttatctgtcaatattactcataaattaaatgtgggaaaagtcaaatatttgaattattgcctctaaatacatcagccaatttaaatttcataatatgccatttcagttgcacatttaatagaatatgcttgaaaatctaaattcgcataagagataaacttgggaatgaactacatcataatggctttaaaatatccctaaaagtgctttttaaagaaaagaatagttcagttcactgggtatatatttacattttattaatatgttgacaaaagtctagtgctttgaaaactaaaatccagagagttgatttttgagtatgaatggtgataaaacataagaaagttatgaaaataacacttgggcaaagttccagtaaaattaattttcagtagcttaatggtaagaaacttggttgtgataaatagatggtgcatatactccaaatccatgggggctggagaggtacagttgcttactctattaacattattcaaataaactaatcatgagaaatgaacaacacaaaagaagtctcaaagaccatgtacttttgaaacttctcattggttagctcatgggttttttctttttttggtgggtctgttagatcaggtttcccacaagggttgcaagggcatgtcaaggatgatgaagaggtgtagaggagtgaggagggattgctgctttgtagatcacctctctctagataaatgacacttttgaccaacagtattttcagcctggtatcaggttctctacaatttagtagcttaagatgtgaaattaaattaaattgaacaagaaccaaacattgcagattggcatcttattcaaacttgatccaaagacatgatagtttgatttgtttgattattataagcatttatttttattgtgcttttcatttgtgtgggaatatccatggctagcgaataatctttgtagttttctattaccttattttacttgctaactcctgaattctttaagccaaaagccctgaatttgatggttttgaagatccctttgaaatcgaaattctagaatcatatgccatagatagagcatgcctggtacagaattgtgaacttgtagcaaccgctgccacaaaactgctggaatactccacttattaggatgtaattttcatcagggtctagaccaaatgctgccattgcacaggacatcataccacaaatgggaccaaagcaatgcagctagtttctcaactttgcttagagaagtaagccagatatggctcattctctgcttgccttcaccagtgccagaagtccaagactccggagaagtcaatcatgactcagactgttctcataccgtggtgcacgacctgtgaggtgactcagtatcccacttcccccttcttctgaagtcctttagcagtggactctggaacaccaattttttgagacagagtcttgctctgtcgcccaggctggagtgcagtggtgcgacctcagcttattgcaacctccacctcccgagttcaagcgattctcctgcctcagcctcctgagtagctgggactacaggggtgcaccaccaggcctggctaatttttgtatttttagtagagatggggcctcaccatgttggccaggctggttccaaactcctgatttcaggtgatctgcctgccttagcctcccaaagtgctgggattactggcatgagccaccacatccgtccttgaaacaccaaatttttgacctgcacgtttctttatattttaaatctgatctttgaatactgcattttccttagccttcctgccccactcaggcacattttttctacagctatctcaaatatggctcatttttctccgtggaggcccatcgcctatcaagttcctcccaggttcagccacagccaccgggttgcggctccagaccccaggatccctgtgctctcgggggcccaggaagccccttgcccccacaggcttggaagtgcctgctcccattctctagcctcttcttgctcccagtggctgctcccgggcggagcaaagttgtggctgagcccaggcaccatcgtgacctggcctagtgtgcacgcatttggggcgatgctgacacgtcagccccctaccgccttggctccctctggactttggccaccaacgatcatgggaggaaggctgagaggatattcagggcggctcagcacgggcctgcagaggaccctcagcaagaacagcctggacgcggtggatggcatgttgatggcaccaggaggtagacaggctcttgagtggaaaggggtgggtcccaggtgaaatcccaccttcaagccggggatggcctgaagactggaggctgggctgtcagttttggatggagtctgtggcccagagtgagaatttacggtgctttttccaggccgcccatggccactcatggaccaatcagcacacactttctccctcctgagcacgtaaaaaccccagatccacctgactaggacagacattcggactaccagctgtggaaaggtgctacccactacaggtctcctcactgagagctggacacttgctgggcgacctgcctgcagaaaggacctacccagtatgggtctcctctccactgagagctgggctctccttggaatgacacacctgcagaaaggagctaccaactgtgggtctcctctgagctgtcctgtcactcactaaagctcctgtctgtcttgcttactctctagttgtctgcatatctcattcttcctggatacaggacaagaactcgggacccactgaatggcgggactgaaagagctgtaacgcaaacagggccgaagcacgcccccccaccctccgctcaccacgttgggggtgacaagaaggaaagaagagctgcggcccttcggggattctagacccaggggctccctgagccaggggtgtgacaccctttttggggctccgtggttcctggcgtctccaaggttccggcaccactgcgttcccctcatccagacacgggtgccctcagtggaagctgcttgcagtacatctgatccagtcacagtcctgcacgaagccagtgcctgtgccggctcctggacctgcctgccccgctgcagtaactggcatgcctggctgtgtgcaatggccagaccccatgcttgcttgctcacacaccccttgccactctgcacctggcttgcccttggtaggcatgggatccaggctgctagactgaactgagctcagcctgctaggctaagtgggcggaacaaacccagtgggcctgaacaagaactcgggcaaaggcgccaccggccacagaggtttccagctggaaaagtgacaccctaaggattccgagacactattggattggggcccaacttttatgacctcattcacccttcattagttcctaaaaggtcttatctgcaaatatatttagacttgggaggccttgagtatataaatttgacaggggttgggtggggggcggggacacagattagtctgtaacaccgggtgattatctttttatacaaataccctcaattttcttttattattttttaaaaactcaccccaatgctcataaatatgtctcagctactgctggttccttttctaactaaactttaaatattggttattaggaattgctcccagttgctcttctgtttttgcaatctcttactagatgatctctgtaagggcaaacacaaattaaaattaagagggttaatttcccctgttgagaataaggaaagagaattcttgcccctttcttttcttatagaattactttagaaaacttgtattttcttcatttctttgaaatgtatttaaatatttttaaaagctaaataaacctcttgccagttttaagggagaagaatgtctttatcaaggacctggaaaacatctctttggaatgtaaatattaaaggaagataagtgcctccatctcccaggttctgtgggagggtaggacctaacttcagctaaagcttggctctaagttgcaaaactactgtctatcatacagatatgagaagtgtattttcctttatataaagccacctaactagtcaccccaatcgctaggtgaattgctgtgtgtgaaaaataccgctgccaagttcttgacttgaggactagtcattctttatcttgagggcctgaatgtaatgagttgtatctacttggctacataaagggataagatttctttccatctttgccatttcttagcaaattgcctgggatgtatatcacattctggtttaatacttgttcaataataaaattgttttctgctatctttgtggagaggttatccaggatgggaggataattggttttcaattatattttcctaatatctcattcatattttttgctggctcccaaatctgatctctggccaaggcctcttctctaagtcagattctctagatttccacatggatgtcttgcagtcatttcaattaaaaaaaaataaaacaaactcaaaatacaatccccaatgttgtcttctacaccttgtcatcaccaagtttctgccatttcaatgtaacgtgcaactgttgaatggttcctgcaaacactatattgactttttttcttattacacaccagctttattttttattttattttagcaatgtgtcagcaaagcctcttgcttgtatttccattcaagaccaatgtaatttcaatgtagatcttgatgttgtcatcttctctggtcttactagtctaacatcctataattttgtgatgggaatattgtaatattgcttatctttctttgttgatttttacctctccctaaactacattccacaccataacacattttcttaacaagtctgtctcttaacacaacagtctatttgcaaaatgtgtttgaccataggacagttttgtaacttttgtgattttcattgagctattaacatttccattcgctcattaattcataccaaaaatatttattaagaaaggactgtgtgccaagaaggtaactagctttacttggaatgcaaattgataaatataacactaagacatacaattaatttattttctttgtgaagttatttgataaaattagaattgatttaccacctacatggtcaaatgtaatgctgttaatgaaagtcagtgcattccatacaataccaacttatttattaagcataaatcagagctatggcagatgtggccaaggagatgccctgtactggaccactcactgtgtaattaaatgttcctgtctcacagtgctctccaaacattacagagattctttttttctctaatgaaaataattgtttctttatagtaagtagtctactgctgtgatatttccaggaaatgcatattatgaaaaactagaaattgaatcagaagcataaagtagcccatcagctgaactctcaggattcacagacctgttgaggtccaaagtgaagtaggttgtaaaatcactgttatctcactgacagggttaaagtttttgaatatgttcaatgaaaaattgaaatatgagaagtaagataaaaattcatgaataagattgtttttatgcagcacctgttagttttcaggcatttatctaggcatctccaaaatttgtggtgcatcagtgaataaaatgctccttttcactcttccctatcttacacatctgggcatggggaaatagaatataaaaataagcatgatgataagtaaattgtagtgttatgttatgaaaacatgactaacagagaattgtaaggtggatataaggtacatgagtcagggtgccagatggggacagctaacaggattaaataaggtggtgaggggaggttttcttgcaagaggatttgaagacagttgaatgaattgagagttttagccaatgggatatctgggacaatgagatacctgcagaggggccaggtagaaaaaaggcgctagagtggggacctgatgagtgtgtttgaggcactgcatggaggccagttggcctaaagtggagtgagcaggagagaggagtagtaggagggaagaggaagtaagaatggcagcagcgagccagattacctatggccttaggtgtcatcaggctgttgtgaagacttggcctctaattctgtttacgatggggactcattatagggaactgagcagaagagcacattgtctcacttatagtcaaacaatcacttggccgggtgtggtggctcattactgtaatcccaatattttgggaggccaaagtgggtggatcaccggaggtcaggagttgaagaccagccttgccaacatggtgaaaccccatctctactaaaaaaatacaaaactcagccaggtgtgttggcagacacctgtaatctcagctactcaggaggctaaggcaagagaattgctggaacccgggaggctgaggttgcagtgagccaagacgatgccattgcactccagcctgggctgacgacagtgagactgtctcaaaacaacaacaacaacaaaaacaatcactttagctgcagtgataactttagggatgaaaggaagaagaaaggcaatatgttagaggttactgcaataacacaaataatcggtgataatagagatagacaggaattagaagtggatttcatgtgagtgcttggtttctggacatcctgtgaagatcaaggcccctgatttgcttttagactggatatagattgttagagaaacagaatgactccaaggttttggcctatgtcattggaagatttgagttgttatctactgagaagggaagtcacagatggagtagtttttgtgtgtgtggttttagattgtgttagtagagaggatatcagaagttcagtttggtgtttcttatactgaaggcaactctgggatatttacgccaatgcagaagtggataggcagatggggagcttcatgtctgcagtttgagagataggtctgggcaagagatggaaatctgggagttaacagttcataggtggtattttaaatgatgaaactagttgacagcaattgaattagtataggtaaaaaggtaaagagaactaaggatgaagctttggggtgcgccaatatatagagttccagacaacagaggagaaatagtgaagaaaattgtaaagaaatgtagtagaaggaaaaccagccaagtcagttgtttgaagtacattttggtgtaatcaataataacattttttttgtagattgatatgaagggatgagggctgaactaagtctccatcaggctgatagagtgtgatggagaggaaggacttgtggcctaagtagctgccagtggctccacactgcagcactcacaaagaccacatgccttaaagctctgctgtcaccgtcttgacatgcttaataattcaataattattcaattagtatttaagaataattcaatacttcaatttttaacaagtccttccattttaattttacattgggccccatatataatgggattggagtatctgatgatagagaatgttggggaattgcattctatttttagattatgttttaagtatgtgatgtataatacagaagcaacttatttagagatgatttggaaaaaatcatagatctttttctgattaaatcccctcctccctgccatttcttacagtagagtttcataatcttttccaaacaaaaatagaatttctaattgctaaaagactttatgttatatgcatagttctgccaattgctttctggatggtagatgtgtctaatacaatatttacttgctttagaaatagatatatttggattaaaatcctttctctgttttttaatatttgtgaccttgaaaaaagtatataacatttttgaatttcattaacttcatccaaacagtaaaatgtatagtatctttcttcagagaatataaataataaactgaaacgcctgacacacactaagtacttattaaatggtagctattatgatgatttcttagaaaaaattgttccatgtcttaattttctctcttttgaaactcaaaaatatctatatgcctaccttaaatttggggaattaaaaaaagagataatgcataattttatttacttgtatagcaaaacaacttatttttgaataggtaatccaggcttactgtataaaataaaatggtattataaaaacagttgtattgtgaaagtttctatcctccagtcttttagctcccctcccaaaatttaaccacttaacatatttctctgtatccatcaggattctttttgcctttcaaaaatggtagcatgcaatacacactcctgttccccttgatttttttttaaccttggcttaggtattatacctttatcaatgcatatagagattcctccttttttttctctaaatagagactctctatcaaggtgaccctccaagaagcatggacaaagcagaacatgtttaggggctaaccacggagaatgtactattcacttttaaatacaagtaagagatacctaacaatacataggttctccaaagagctcataggtggtatttaaaatgatgaaactagttcccaggagaccctgcgaaaaagttagcaataaacactatcagatctaaaaagcaggatgccagttggtcaaataaaacatatatgtatattttttgctcgtcccttctacctgttttggtcctggaagggccaaagtttatgggtagcaagagtgtaaatcagcacaagaacaagacaaaaacaattaaaccggccaataaactccccatctttaacatggttggcagtcactaagtcaaagctctgagaagggagaatacctatgactacgaaaaagtttaaagtttagttattgttatgggctgaattgtgtcccccccaaaattcacatgttgaagtcttaacccccagtagtggaatatctagtaagccccagtgcaactgtatttggagatagagtcttataaagataattaagattaaatgaactctttagggtgaaccctaattcaataggactgctctccttataagaggaggagattagaacacagtcgcgggggaatgactatgtgaaggcagagagacaatggccatctaaaagccaaggagaaacaaccctgctgacaccttcatcttggacttttaacccccacatctgtgagaaaacactacatatattgattactaacccaaggatactttgctacataaagtggcaaggaaattaacaggacttgttttaacttcaccccaaagccaaaagaactagtaccaggaaacacatttaaaagagaaaaggagaaaaaaacccagtaaagacacttgaaaatgatatctcatgaatcctgcctattaaaacattggtttgcacatagatgcacttcgggagagttgaaattttatgatacttttcttaatgtatcccctgccattatttgaagttatctttttcccttttagtgatattaaaaatgtcttcatgtagattctggctagttttaaaatttagttttatatattatgcataaatctagtattttcttccgtaatatctatatggaagtttattttacatacaggaaggatattggtatgttaattttgactccagctgccacactaatttatctcaatgtttacatgactttttttagtcaaatcttttggattttgtatgtaagttatacaattatttgcaaattgtgatagctttatgtcctcctctatgtcttttattatggtaataccttaaaaactttaaatgagagtaactgtggtagacaccaaatataaacaactttttcagctgacgtagattttgtaaaaactcttaaagaaaaatacatatacttaaaacaatatttaaaaaataaagaatggatactgaattatataaaaacctcagtatctatggagaagatcacatcattttgattttgtttttatcctatggtgaattatattaatatgtttcctgattttgatatgttcttgcatgtatgggatatactctgtggtgtttcttactgttgatcatatttgtttattggtttcaggatttttacattacttagcatgagtaaaacagatatatagcttttaaaaatatatgtactttggtgcttattgtcagttttcttggacttgattaaaaaaaaagaacttggggctttcacttctgtttatgccacagtgaatgttactggacataccttcttgacgttaaataaaactaaaaaccaaaaaattctagcaatatgaacaagctatatgaaacaattatttttcagaaattgaaagataggcagtgtaggactatgacccctgaaaaaagggaaacaaataatctaagccatacaatcaccccacattacagactgcagccatttcccaggtcatggagtagaggggtaaacacaggcagagcacaggggtctcaatgaattgcagagatgagtctcagagttcagggaaattgaggcaaactgaaatttggggcaaaatatttgaggcaaggtagctacccaaataaatagctctagaaatctgaaaaaaaaaaaaaaaaaaaaaaaaaaaaaaacccaaaaaaacaaaaaacaaaaaacaaaaaactggttaagcactaaccacacatgggagagagtaagactccaccagaccagcaaaagaagacattctgagaaagaagtgccagggacttctaagctagaaaatgtctactactcaaagagggctgtgaggagtttgctatccaaacagtcagatgtcacaatgatatcactgcctcactgtgaaattataagaatgattatatatatagtactacttagctaactcttgagtgaaatctaaatcctctaaaatacacttaaaaactattctctagattaagctgcattgcatttagctgactctgaccagactaaacccatccctctttcaagatagaaaacaaaatattagcattcaacaatatcacaattacaatgtccacaatccaatcagaaattactagacatgagaaaagacaggaaaatgtgaccattaacatgtcgaattgattaatagtcataaaaatagaaatgaaagagatggtagattagcataagaactttaaaaagactattataattatttttgagagcttaaaggaaaacatgtacatgatgaagaaagaactagaagaattttaaaaagagccaaatatcttcagagataaagaatccagtatataaaataaaatttcactggatagatttaacagcagaatagatatagaggatccacaagcttgtagagttttgtcaaatttcatcaaactgtcctcttaaaatgaatgcattttattgtattaaaattacactttaataaaattcactttcaaaaaaattagaaactttcattcttattctaagttctagagcatcctagatagattgaaatttctgtcttaaagatgagagacctttctctgagaaaagtgtgtggtcctcttgattttgttgagagtagaatctcttttactactttctcgatttattttatggagttttatttttattttctctcatttctggggttagggtttgtagtatatatcaacctataaataatttcaccagaatctcaaattacttgcataaagatgggtaaaatggtctcttttgctttttaaatttatcatatgtacctggttactttctcagtatcatttctcattttatgttatttgttcattataatacaattatatatcataattatatattagctataattatatatataatggcattaatatgtagagctcagtttcacagaaatgaaagaaatacatattcagcttgcttaggtcttaaatactcctatgacaagtatgtatttaagtaaactttgatgctttatgtgattatttatactattttactttcaatgtaattgcttcctttaagtacaaagtaacatttttcttaaagggctagctctttctcttctaaatatatgtgattattttcaaattcaaacgtaagcaaaagtagaaaaaagtagtatcaatgaatttccttgaatccattgcccagattccacaaactgtcaattttcttctcttccagttttatttctttttccactatttttttccaaatgttttgaagcaaatcccattttatctgtaaataccttagtacatatcactaccagataagaaactttgaagctgaacctgaatgtaatcaagcttttatattaacacgcctatgggaaatacaggcaataaggaaaagcaactaaaatgacattataaggatgtaaatagccaaatctagaatatgagatattgtaccggacaaatgacacaaaaaaatagcatggatgagaagacatgaagagggagaatttttgtctaggtagtaagccttaagacatatactatgcagatgcatctgtggaaagtgtttgaatcctgatgaactgtcagaaaaatcatcttgaggcaatcataataaactgtacacagaaattaaatgatattaaggaaaaatattaattttcttgggtttgatactggtgttgtggttttccttttttttaataaaagagaaaaacctttaaaattataaaattcatgttatcgaggagaaaagcattattactcagaattactgtacttcattgtttagcttaagggtagattgtgagatacaatttgctgagttaagttttgtttaggttttaatacctgaaaacgtattttcccttacagaacttcttgtatcatgaatatactccctttcttaaaaaaaaatgactatgattataacattcttcataatttcttctgtattggagttttatttttaattttttaaataaacctaacccacaatgaatattgccaagatgaaggtctatttgctctagccacatcgtttgaaagggggttgaaacatcctctcattgagagtaaagatacaggaaatggtgggggtttcttgctcctaaggtgtccctgcagctgtgcctcagacttagtaatttcacagaaaacagattgaggccttctgttttacccaaagaaagttggacttagatgctggtgggatggaaagaggagatattttcaattaagagtccctgtagggagacctatagggagagatgcagaatactgcctagatccccggtttaggactgaagcactgattgccttatgtgctaggcgtgttggcttctgagggctcataggtgagtagagctaaggattgtttctggttaaagcaggcttccttactcaacccccaagaggttatgttgcctacctttgtagtgattcaagggtgaagcaacttggcctcaaatggaaatatctctaagaggccattttggccagtcaggatatcagctgaaacctgcgttgcaagtctattgctgttcacctcttctacctaatattgcttctgtcatgcccttacaaaaattgtttctggaagcaatgtctactaaactacctgtttttccccagattctctttcttgggaaaatgacccatggtagaactccacaaattgagatgaaaggtaattacatataatatttctaagtagttgactccaatcactgttatactaaatgacattcagtggctgatttagggggaaaatgacttgaaataaatgttaaatgtacgacttacaaaatataggactttagccattgaaataatctgatacaacctggaaaatacatgggttaagtaatggctgtaaaattgacctagtggagctacatagagagtggaaagcatagttcattgcacccactaaattcagtagtatggttttcccctcaagctatagagtaagaaagaggtcgacaacttagcaatttgcagcagacagtccaccattagcaagaggaaagagatcactaactcatttttcaaagactctctttaggactttacctgtcaaggtcatgatcaaatttatgctttagtcttcaaaaatgctatgtctccatgtcagtattttcaagtctgtaatttatagggccaaatcacatattttggaggtacttattctacaaaaacctttctgtcttaaatattatcatctttgtactcaaaagaactgtatttccttttcttttatattttgaaaaatatgtctaaggtttctttttccacgtcaggctcattgttcttgatatgctgttagcattaaataacataaaaacaccaaaagggaatcaaaaaggaataaagaaagaattgggcgcaaggggattattctgttatattaggatgtaatttacataaagtaaaatttgctagctgcaagagcacaattcgataaatttcaacaaatgtcgacagtcatataccacaatgatgatcatgatataagacttttccatcaccccaagttttcttataccactttacagacaatcccacactctgatccctaaatgcctgtaatcactgatccgctgctgtcatcaaaattttgccttttctagaattttacctgaatggaatcatacaatagtagctgtttttgtctacattcttttgcttagcgtgatgtttttgagattcatacatgagatgctcattttttttttttttttgctgaatggaatttcattgtacagatttatcacaattatccattaaccagtttttaacatttattttctttctagtttttggttattacaaataaagctgtgttgatattccagcacaagtctttgtgtgagaatacattttctccaagtaaatacctagtagtggaattgctgggtcaggtgctatgtatatgtttaatttaataaaccaccaaactattttccaaagtgactgtaccagcattactgcatttttaccagtaatgtatgagtattccagtttctccacattttgaccaacacttggtattgtagattttaaaacaattttagtcattcaagtgattatgtaatgtcattatgattttagtttgcattatgattttagtatgcatttagtctcaaaactaaagcataatgtaaatcctgtatcagatacatattttgcaagtgttttcttccatctgtggcttgcattttcttgattttttaagcagtatcttttgaataagaaattttaagtgtgtcaattttaacaattgtattttatgtatagtgtgttttaaaaattcatcccaagaagtatttttctgatctaaagtcacaagattttccatgggttttcttatcgaaattttatgtgtttagttctgacagttaggtgaattcaagttacttttcataaatggtatgaggaaaggaatgaggctgatttttctttttcttttttttttttttttgagacggagtctcgctctgtcgcccatgctggagtgcggtggcgccatctcagctcactgcaagctccgcctcccgggttcacgccattctcctgcctcagcctcccgagtagctgggactacaggcgcccaccatcaagcccggctaattttttttgcatttttcagtagagacggggtttcaccgtgttagccaggatggtctcaatctcctgacctcgtgatctgcccgcctcggcctcccaaagtgctgggattacaggtgtgagccaccgtgcccggcctgattttttttacatgtggaaattcaattgttccagcaacaattttgggaaagactatcctttctctgttcacttacctgagcacctttgtcaaatattaatttacatatgtattaatctattttggggcactttctttagttccatgtatttatacgtctatacttacatcaatatcatattgtttttgttggtctgatagtgtaagttctccaactttttcttttttcaaaattgttttgactagctttggttctttgcatttccacgtacattttaggaagagctcctcaatttgaccaacaaaaaaagaatgctggaatgtgatttggatgtcactgaatctgttagtcaatttggagaaaattattatcttaataatactgagtcttgccagtagatacttacatgttcctcagtaacgttttgcagtttacagagtaccgatcttgtacctatttagttaagttgatccttcagtatttcatacttttatgctgttgttctatcttcttattaaaatttcaaattgcatcctaacattcaggaataaaattgttaaaatattgacaacgtgtcataaagctttgctaagattctttttatagttctaatagcttatgagtagattccttaggactttctacatggatattttgtttttgaaaagacagttttactcctttctttccaaagttcttgctttctatatatttttatgcctttattgcattgatggggacttccagggtaatgttgactaggagacatgaggcgttgcacatcttgcatccttaccaatcttaggtgaaaggtatccagcctttctccctaaaacacggtaggtgtaggtttttcacagatgctctgtatcagattgaagatgatcctgtcaattcccattgtgctaaagatggctgtttaattttgtcaaatcaaaaaaaaaaaaagtaaaatgaccatatggctttactcttttattttgtcaatatggtggtaaattgcataattttcaaaagctaaatcaaccttgcattcctggaataaaattcaattgatcctgatatattatacttttttcgtattgctgaattcaatttgctaaaattatatcaaggatatatttgcatctatcatcataaggtgtagtgctctattattttcttgtgtaatgtcctcatctggttttttttatggagggtactgctggcttcatgaaattagttataaagaacagaattttcttctgtttctaaaagagttaatagaggactgttactacttccttaaaagtttggtaaatttcatcagtaaagccacttagatctggagtctttcctcttaatttttccgcttttaggaacttaatcatttcttttgtgaatatggatacacatatcacatgttaaggatgtatccttagtgaccctgatgaaattgtttgctcttttaccacgaaggttatcctaaagatttgatccataaagcgagacgaattatgctaggttggctgagtgcttagcactagaatggacaaagggccatactgttgctggggagcacattggagccccgtgagtgtccccatatttggaaatggtacatactttcttatatggtttcagatcagagtgtttattgtctactcttccctccctgaactgtggctcactaatggttttttcatctagccctgcactcctccgaatatagtataatccctagtgcatttttaatacttatgtaataaatggagtttgtcttcagttgtatcagagatttgccagtttactaaacataaacaacaaaactcttaacaaaatagtcaaaagaaactctagattaactatggtgtagacatatcaaaatatctttctatctcatttttgatccattaagtgtcactttttccaatttttaagtagagtttattttttagagcagttttagattcatagaaaaattgagtggaaggtgcagagatttcccatatactacattcccatatgtatctgcctccacatatgcccagcctccccaactatcaaatttctataccagaatggtacaattgttacaatcaatgaatctacattgacatattagcactcaaagtctgtagtttacattatggttcacttttgctgttagtgttggaccaaatatataataaaatgtatgcaccattatagtaccatacagagtagattcattgccctaaaaatcctctgttccatgcctgttcgtccctccctctccggtaacccctggcagttattaatctttttaatgtctctatagttttgtcttttccagactgttatgtagttgaactcatacagtatgtcgacttttcagactagtgtctttcatttaataatatgtatttaaggttcctccatgtcatttcatggcttgatagctcatttatttttagtaatgaataacattccattttctggacttaccagagtttgtttatccattcacctaccaaaggatatcttggctgtttaaaatgttttggcaattatgaacgttttggcaattatgaataaagctgcaatgaatatctgtatatgggcatttgtatgcacaaaagttttcaccacatttggataaatactaaggggcatgaatgatgaatcatatggtaagagtatatctagttttataaggaactgccaaacaatcttccaaagtggccaaaccattttgcatttcagacaactgaggaccaatagttctagcttggtccacacacttgccagcatttgaagttgtccgtgttcggaatttttgtcattttaatagatgcgtagtcttacttcatggttgttttactttgccactcccgaatcacatatgatgttgagcttcttaggcttatttgtcatcagtacatctttggtgaggcatcagctcaggtctttggcccattatttaattggattgctcacattcttattgttaatttttgagttctttgtatatttagaatgagtcctttaccagataattcgtttgcaaatagtttctcctaatctgtagcttatcttcttattctttgagcagtgtctttcacagagcagaagtttttaattctaataagttcagctgatcaattctatttttttcatggatcaaacctttggtggtatatctaagaagtcatcaccatacccaggaccatcttgtttttcttgtcatgtttgagaattttatagttttgctgttaggcctatcatccattttgagttaatttttatgaagggttagggtctgtatctagatttattctttggcatgtggatgttcagttgttccagcacaattgagaagagtgtctttgacctattgtatttcaaagatcagttaattatatttgtgtgggtctatttctgagccctctatttgttacattgatttgtgtattagttcaccagtaccacactttcttaattgctgtactaatcagtaatcttacaataagtcttgaggtcaggtagtgtcagccctctgactttgtccttctctttcaatatcatgtgactattctggatttttgctaccccatgcaaactttagagtttacatttcagtttattgatatccgtgaaagaacttgctgagattttgattggggttgcatcaaatctatagactggcttgagaaaaattgacattgtgacaatattaagttttcctatgcatgaacatggaatatctcaccatttatatatgttttgatttctttcaacagtgttttatggtttgcctcacatagaacttctacaaatttaattagatttatctctaattatttcatgttttggggtgtaattgatactgtgtttataatttcaaattctacttactcattgctggtataaagaaaagtgattttgtaaaatattaaccttgtaccctgcaaccttgctataaacatttattgtgggagcatttttttgtttattttcttgaattttctatgtagacaaacatgtaatatgtgaataaaaacagttctattttttccttctcatctagcatcacctttattttcttttcttggcttattacattagctagaatttgctattgaagttgaaggtgttctttcctattcctactttgctgagagttggaaaaatcacaaatgagtgttggattttgccacatgatttttgcatgtctattgatatgatcgtgtggtgtttcttctttagcctgttgatgtaatgggttatattaattgatttataaatggtgaatcagacatgaatacttgaaataaatcccacctggtcatggtgtatatttctttatatagattgttgggtttgatttgctaatgttttgttgaggattgttgcattacgttcaggagaggcatcgttctgtattttcttttcttgtaatgtccttgcttcgttttggtattatattaatgccagcttcatagaataaagtagagagtattccctcttctgtcttctgactgtatggaattatagatgggtggattttttttttctctcaagactttaaatacttcaccctactccctttttgttacatggtttctgagacattagatacagtcggagccccacaacctgcccatctgaaagctccccctagaggtttgagcagtggggcaccgaagaaacgagccacacccccattgcatactcttcaagggggagaagggaactttcccagtttcagtttggtgtctgacatcagtttgagagaattcttggtcattacttcctatatttcttccttttatttatctctttcttctcctgctgctgtttccattacatatgtgttattccttgtagttgtccaaagttcttggatattctgttctactttttgagtcttttttcctcttggcttttgagtttttgaagattctttttagttttcaaagattctttcttcagctgtgtctagtctactgctaagtccatcaaaagcattcctcatttctgttacagtttttttgatctctagcctttattatttttttttagaatttttatttctctacttacattgcccatctgttcttgcatgctactttacccattagagcctttagcatattaattctacttgtttaaattcccagtctgataattcaaacatctctgccatctatgcctgtgactctgatgcttgctccatctcttcaaactgtgttttttttttcttattagtatgcattgcgggtttttctagatagctggacataatgtactgggtcaaaagagctgtggtaaataggcctttggtaatgtggtggtaaggtatggaagaaaaggtagccttctattatcctataattatttctcagtgttgtagtgagcttttgcccccaggctgtgaacttcactagtgtgtctcagttcctctctcctttccacttagatgggacaggatggctagagtgggctgaagtttggtatttcccttctggtaggttgattaagcttgggaaaaacactcaacagtgtaaactctaataaaatagtttctcttgaggtcaggtcccggtaagaacagaattctcccatgtatttcaaaattatgacctttccctccacccttgaagtacaaggggatttttctccgatatgtgaaaatctggctgaactcctttctactgtaagtcagcagtacacttacagaagtgtgtgtggccccatatggctagatttcctgaagtttttaactcggccttatccatactgagcttccaccaatttgtcacttagttttatgtttttcacaaaggcactggctcccatggaggattctgcttgtggacctgctcaggaaagttgtgattctctgtaatctgtctttccagtttgtggagggggaagcaggctgtcctgggacctcacttatctgatgaatctaagaagagttgttgaattttcagtttgtttagctttttgcctctttgttagaataaagtgtttactttcaagctccttatatcctgagccagaaactggaagtcctcttacctgttagtattttaattagataatccctacacattcaactgaatgtgaatttgtgaacttgtatgtagtgtttaccaaagagatttgccaagcttgtgagtatatcatagtggtattaacaggatttcccatccccacgatcccctaaaaacaaccaaaaaaaatttccattgtagctttgtaatactcaaaggagaacaataaacctttgacttaaaaatgatgagtaggaatatttttgtgatgtacagtggcattgtggcactgaaaatgtgatagattttaacatagtcagaatttaaactttagctttttcactttttagccatattatgtaaaggaagatatataatgtctttgaatttatatttccctactagttttaaaaaagtgatttttgaaatattgagtaaaataatatttaggacaattcttatataggtactcaaatattttctccaacttatgtaaaatttgctcattttggggaatctgaagattataattaaaagagctctatttgtataaaaggaagacagaacattttggaaggctgttacaagagttaaagaagagagaactgatagaaaagtgggaaatggataagacttaactcataaatgtaaattaaatggtaatactagattttaatttgatataaaatttcttacttagaacaacctaaagcgcattgacttcaaattggttggtcagagtagaagaatccaagaaaatgccaatatcaatctcaatttagagtaaaaggaagccaggagagcgcaggcaagtgtccaggttcttttaaaataaatcatctagatacatgaaagccatcctagaaaggagtctggtgggtggcagagtccagatcattcaattctacttaatttggaaagaaatccagtgccagattatacaatgaatgcacaaggtttaaattgagtaactgctcaattgtagaaaatatgtgtttatcttttcaattttttcccatactctgatttacttccattgattttcttgccaaattaactaggatgaattctacatcaaataaaatagtctgtaggaatcatttgggcatttttttagaggtgattctttgaagaacttaatgttttaaattgtcatttacctatgtactcacaaacattgtaaaactgtattagaggtcgtcctaccagcatttgaaattgtctgcctattatctctgtagagtactgtttgctgtagtattaaaacaattttgcaaagcttgaaagtaggaaatttgtttattttgcttgttttagtaaaaacaggtgtgacagaatctaaaaagaaagtgctatagaatcaaatcaaatcacaaaaacaagaagtgccattttcatagatagaaattttggaaatcagttgtttttggtttatagtttttccatgctaacacgcagtattcattaataaaacatagtcattctttattatagacaaagcaaatgttccatacaccaccctagagaaagaccatttagaaataaacaagtggtgctgaaggagatgtgtaatttagcaaaaatagccacccaagctgagttatcttttgggaaaaggaaataggagacaaacaactatcctgaagggagttgatttggaaggaaattaaacattttcccatgagaagcacagcttagagagatatcaagtgtttgtgaatatcacccagcagccattcaagacaaaaagaacacccaaatgacatataaacaaatatgttttcttttgtagttgttcatttgtaagtttttaaaattacttgtaatctgttaaaaatctcattggtcttttgttattaattcaaaagcattcttatattttcaactttttaaaatttaattcttgccttcagtttccctaatattttgtaaatctccttttgaatcagcattttgcacttcacttttattagcatcgttttttttcttaaaggtgaagcaagtttcttatctttaaagatttgccatttcagctttttattagtgactttgaagtccttaaaatatctctcctgatttaaccttacaataatcttagtcctatgtttgctaaaaatcaaagccaaagatgatattcaaagttgattttgtcctaaaaaatcttattttggaggtttccatctgaaattaaaatagaattttatagtttataattcactgaaatattgtggacagggtaaacatttggaagccctcttatcatttcctcttgtcatctcaacttcagactccctgcagtcattgaggcgagctaagcatgccagtggaactctacaaccttacacaaagaaatctagttttcttttgctagtcaacaactactcactgtatcttgacttcaacttatgacatctcttggtcttgttcatttcaatgctcatatgtgaagagttgcccaaataactccattaatgaaatgcaatctatgtgagagtcttcctctgccattctgtggttagcatgctgatggtctatgccctgttttttatactatttttatttatttattcatttacttatttatttttgagatggagtcttgctctgtcacccaggctggagtgcagtggggtgatctcagctcactgcaacctccacctcccaggttcaagcgattctcctgcctcagcctcctgagtagctgggacaacaggcgcctgcccccatgcccaactaatttttgtatttttagtagagacggggtttcaccatgttgtccaggctggtctcgaactcctgacctcaggtgattcacctgccttggcctcccaaagtgttgggattacaggcgtgagccactgtgcccggccctatgccctattttatgtctccgaaacagaaaggagagacatgcaaacacattttcatgaggaattgtggctcacttcctcaattctcagctatttttgcagctttaattttactttctgaggaatgtaagaatattatccaagcaaatacaagcctttggttaaaatcactggataatgtaacacttgatcaataatcctatttccagtgattttcctaatcataacattttattcacaaacatccagacagttatatttacattcaactcaccttcttggtgtgggctcttaccaaaacagacctgagaaaaggtttcaagtatacaactgggaagatggtaccaggaaacactggtagggaagtgaattaaaacaggcaaatgaacaaaccgtagttgctatatgccactgactaaagaaggtactactacttctggtgaggttaatctcactgtggaattctgtggcagactctagattttgcattatacttgttccatccaagcgactgggaaactgtttttatttaggtttgtttgtttagcaaaattcttatgtgtgatttgttgatatcttcgtttggaaacatcaatgcccaatatttctcactggtcctatagaggcctgaacttgcttccacagcttggaaatagaaatttttcaggcagaaagtagcaatgtttatgctaagtatatcttttcatgtcaggacatagaggtgagatatgagagtatcctgacatggtgtagacagtagctgctatgcatccgcaccctatccataaccttgtcctactagccacgtatggtcttcatgaaatatgggaggtagctttagttttgtgattgttaattttgtgtgtcaacttgactgctaagagatgcccagacacctggtaaaacattgtttttggatatgtttgtgagggtgtttgcagaagagattgacatttgaatcagtggactgagtaaagacctatcaacacccatgtgggtgagcacggtcctatttgttcggggctcaaataccaaaaaaggcaaaaaaaaaaaaaaaaggataaattctttctctctcttttttagctgagacatccatcttctcctactctcaaacatcagagattctgacatatgggcctttggactttgggacttacactagggctcccctgccaccctctcacccccagttctcagacctttggcctctgactgaactacaccactgtcatcttggttctgaagcttacagaagacgtatcacaggaattcttggcctccataattgcacgagtcaattcccataatctccttttacatatctattctcttattgattctgtttctctggacaacctcaactaatataagtttgtcaaatgtttgcctggaatcatcctaggaattactcttcccagatacctatattatagaagttcaggaatgttggccagatacctttccttgccccatatggaatagttaatgtttactgatgcttaatcagttccaaactctacatactattgaataaatcacttaatacaaccacatactgagctatctgatattaattccatttttactgatgatgaaactgagtcaagataagttacaatatttagttaaggtaacacaggttcttatggtatgatttcaatgcaggcatgtttcatccaaagccctggttataattattcttcattcctagattatcaaatcttcttaatcaatcaatgtcaggtcatgttgatatctggcaatgttggagtatgtttcattttgagaatggtaaatattccttaggatcactttggaaactttttttttgattgattgattgtcatcttaaaagtatataagtaagaacacctcatcataccacaaagtctctactagtgacagtgaaaacccacggagtcaactaatattctacctatgcacttgcatttgatgtgctggctttaatcaatgccaggaagctccagtttttaatctttgagcagatatacacatgtgcatatcaaattttcaagcattctcttaataattagttatttctttgtttcactgtcttcctgtttagttaaccagcagagctagctgatagaggctaatgtgctttacttataatacagtctttttttaaatgtattactagtaaagtattagccaaaattctgagttattgttagtgataacttttaacatttggcagtataatagcatatcagtcagggtttaggctggaaacagaattcacggaaagaaattctgatgaagacagtgaaaaggctatcgtaagatttgggcagaaataaagagacacacaggcatatcgaggcatccagagattagcaataccactgggaagacatttccattcccatgcctaaatgcccaaggtggtgaaagatgttactagaacccagtgagagctggagctcagaaggcccagccacacagctgacctggtggaggaaaccttcctgcctctggtggaggcaactactgccatgagaggcaataatctgaagctggagaaacagagaagaaataacatctttctttcctctaatctcaaagccccagaatgcagaaacaatgatttacatgaaactcaggagttagcctcctggctcacagaggagcaaagaaaagcagaaaccagattggccgggatgtggtgcttaaataaccggtggaaatacttaattttggctcataaatagagcttatattatcttcctttaagactctttctctttctattatactatacttgtactttgttttgtctctttttaaattatttgacttaacaaaactaaattttatgttgtacaaggaggatgcaatgttcattccctctacttcacaaggttgctttggagatcataaaaaatcaattgttttctcaatatcatacacgacccctctgccaactgtggatagactgaagcatggatggtggttatatatgtcctcgaccctctagatacttagaccctcctaggctctttgttcagtactgtgtgaaattataaggaatatataaaattaactgaaagaaagagaaagcagtataattcttaaacacataaaattggctctgtgtataaaaagagtagaaaagaagttgttaaccgcatgggtgagaggaaggtatcagtagtacacatctgaaggattaccatattatagattgagaagaaaagaagtagattaagccggtttagtgtctgggatgaaaaaagagaatagaatacttttcctttaccagaggtgacgactgacagaggtgcaggagaaaagagtatatctatatttattagcagagtatgaattattaaaaggagaattaggagtctataattagtgtgtagcttttctatcctgagctttactaatttgaacataagtttgtgcttttaatcagctgatgaaccaaaagtgggaaagggcataatcaatacaataaactctaaacattttataattccaagattatatagtcccaacatttaatggaggtccaatgaaagcataaatccttgaacttgtgaagctgggcaataacaggctgcttagataattcaaacattatgtacacagcatcaatagaaacagactagaaatttaccaacaagtaagcaggaagcttgccaggctgttcagaaaaaactggagtttaaagatacatccccataatgatccatagaaaacagatgtattcatttgttgcaccaattatctgttacagatccactgatgtgatttcaaaaacaaggaagtaccgtgtgacacaatttgctttgaacttctatttctgaggtctcttatttcctggaattcaaagccaaggaaaagagggctgcagttaatcttccttttagttattattatcatgattatcagaattactattatgaattttttgagtccctttgtacttctgtgtcagtattattaccaatgattacctatgcagtcattataggaactctcctagtaagcccctagaatgtttgtatccaagattcaggtaggttttaggtgatgtctgctcacacttgttttgacataaaacaaaatttcctgctttccaaatgctgtacattgtcttataaacctgagccatttctcttctttgtgaacaaagagttgtaactggccaaaatataacttttgcactctttcattctaaattgctaaaacgtattgtttctgggacgaatgtgctatttaaaaattttgcttctcagtttcatataattagtctcccactctccagaaagctgttggacagactgttggaagtaagatcaggagtctatgagatgaaatttttataactcaaatccctgatcttcattttagttctaaatgttggctaattcttggcagggctcaagagaccctatgtaactacaaaccatctaggaagctggaggccaagaattaggtaaacattgaaagtacttattaatttttgcgggaataatttgatgaattttttatgatgtgagaaaaaaattaaaattagactgtaattttgaaaacaatcacatctgtgcagagtaccttgctctattctaggaaatttaaaaaatagaaggcatgatttctataaaatgagagtatgtatatacatttttgttactagttgtatatggaaacaggacgtttttgaggtttcctgtatatgagactcttcatggctatagaatgaagtttatagcataagatatctatggtcacacttttatcatttctctccaacaacaggcttattttttaaaaaaagtcaggtaccattttacaataaaaaataagtcatttggccaggtgtggtggctcatgcctgtaatcctagcactttgggaggcccaggcgggggtggatcacctgagaggtcaggagttcaaggccagcctggccaacatgatgaaaccccagtctctactaaaaatacaaaaattaactaggcatggtggtgcatgcctgtaatctcagctacttggaggctgaggcaggagaatcgctttaacccgggaaatggaggttgcggtgagcctagatcacaccactgcactccagcctgggcagcaagagtgagactctgtctcaaaaaaaaaaaaaaaaaaaagtcatttaacggatatcatgtttgacaacattatccagaatctggaatattaaccataatactaaaagaacaattagcattatcaaaattataataaaaatatatattaagtattcattgggaacaagtatcaacacgtaattgaaacttaacactttctaacttttctttctttctctttgtagtgccttcttaacacttttaatcatagtttttcaatgtgtaaatcttctttgcagtgttaattgatatttaatatttcagttctcttttctggcaggactacaaaatgcttatgaattttcttgaggttattaatgctgccactttagaaaaacatcaaatttgtctactacgtacaaacagtgtaaattagaaaacagtggtttaggccgggcacagtggctcacgcctgtaatcccagcactttgggagaccgaggcaggcggatcacgaggtcaggagatcgagaccatcctggctaacacggtgaaaccccgtctctactaataatacataaaaaaaaaaaaattagccagatgtggttgcaggtgcctgtagtcccagctactcgggaggctgaggcaggagaatggcctgaacccgggaggcggagcttgcagtgagccgagattgtgccactgcactccagcctgggcgacagagcgagactccctctcaaaaacaaaacaaaaacaaaaacaaaaaacggtggtttctatgcagttactgaaattgtaagagtagtacccaccaaattaacaatttcatgtggttgtacaaaatactcataagtcttgcctttttctggctcttttccttttcattcattaaaaaatagttttcttacgtttgaaaattcttcttaagaaagaagtataaattagccgggagtggaggtgcatggctgcaatctcagctactcaggaggcggaggcaggaaaatcgtttgaacctgggaggcggaggttgcagtcacggtgagactctgtctcaaaaaaaaaagtatgattttcttgaaatttctttcttgacctcctctaaagttcttatgtttatctaggggtgtctgagtctgtcttcttcttcacatactccttcaattttttttttttgagactgaatttgctgttgttgcccaagctggagtgcaacggcatgatctcggttcgcggcaacctctgcctcccaagttcaagcgattctcctgcctcagcctcccaagtagctgggattacaggcctgcaccaccacgcctgactaattttgtatttttagtagagacggggtttccccatgttggtcaggctggtctcgaactcctggcctcaggtgatctgcttgcctcggtctcccaaagtgctaggattataggtgttagccaccataatatttttaattgctttcttggtcaggtgtacataaggaggtgggggacttaaacttcaccatagaatttcctttcaccaaatcttgctgaaatgaacaaaaactagtaaaagtaaataaatgacagaaacaagacaaataaaaagttctaccaacaaagtaaaataagagagagataatctaataaaatcatgttcaaaactccaagccaaggaataaagcaagattcatttcattggttcttgtaggaaaagcaaaaagaaatgacagtttaacaaactgttgtatttctctagaaaccaggatggtttctagagtaaattataaagtcctgaggagttggccattaacatctccaaatgtatagaggaagaaaacaaccttttccctagtctgattgaggaatagtggaaagtactgacagctagaaacacagtaaagcatggtaaattgaacagggctgattctctttaataaattaaagactatatgcctacatatcggattggggaaatgatccaaagcctaatggtacccttctatgtgagtagacatatatcactaaattaactgaaataaataccgctaatgggaaattaacaaaagtcaatgtgttctaataaagactgcatatggcctgaagttaagctattgaaactcaaggataaagacagaatttttttttcgacaagtagaccaataaatatcaactaaaagcaggaaaaattagggtgatcttcaacttctccatagaaacagtcaaagtcacaagacaatgaagcacagtcttcaaaggactgcaggaaagaaaatgcaacccagaaacagtattcatgtacaagtgtgaaagaacttacgaggtatgaaccacgcatttaaagtaaaaaagaaaaaaatattcctaataaggctatttagacaattagagattaatcaaaatcatgagctcaggattcaaagttattgttacttggtgagcacagaaaccattcatatgtagaaataatagtgataaaacaacatggcactacctgttgttactaggtacctgatagttttctaaggacttccttcaattaattttctcaaaattttagaatgtagatactattattatctccattttatagacaagaaaaatggaagtgtaagtggtcaaggcaacttcaaaggcacagaaagaggcagagcaattagtttgaatccaggaagagtcacaaggatggccagcctccctcccacttccactaactgcccctgtagcccccagccctgcaaccataggcattcccgctacagagcacatggggccatcacaaacctggctcagggttattagggaagccatgttgccttttgatatatgttgcattttaatttgaattactgtagatcacttaatgtgaaggaattcctagtatattcacagttatatttttcaatttgccattgttctctttgtcatagctgttattcctttttctctcttgccatcttttggattcatactgtgattattgtatttattcaattttctctgctcttggcttgtcaatgatatgtcctcctgctagtattttagtggtgaccttccagattaaaacgtgcatcctgggcattgttgttattatattattagagtgtatcataaatcggtacttttatattctccagacaagtctagggacatagagcactttaagcacattgatctatctgcctctgtgttcaggactgaatcctgacagatatagatataataactctacagaaaggtcacaaatcataagtatgcaacttgacacaaaatgaaaatatctgtataaacagcacccacatcaagaaacaggacatggccagtataggaaaaattcttatgtcatttaccagtccttaccacctccaagaaaaaccaccatgtgacttctaacattttacaaaaaggttttgtctgctttcaaaccttaaaaatgaaatcacgattaatacatactcttttgccttactttcactcaagactcctacataaacctttgcttctatccatggtatttttttattttaattgctatataatattgcactgtacaaatttactgcaatgttacagatactaattctgtgctataaaccattgaaaaagacatactgacttacaataattatgtatgtaattatatgtatgtatctgtgttatatataaaatgtttatatgttaatttatgtagttatatatgtatattatatattccatgccagaagacaaaacccacagccctaactctcctctgccttactctccatctaagtcttcggtagaacaatgctcttacgattcttagaagcccgattatttcataaagaggatctgaaaggcattccctgaggatatttttaggtcttttttctgtctgaaagattttatgaatcacttcattaaatatttctgggttcttaataaaggatgttatggtgctgagatttgttctttgataatttgagaatgttttgccatgaggggtaggctggaaatgagaagcaattttattttacaacccagtatgtcctggctttttacaagttcaactcttctttatgtcttgtctctcctctcacattttatctcagacaatgagaagataccagatggcactttaaatattctacctgaaaatctccttagctgggtcatcaagttcaatgggcacttttcctagttttctcattactgcagatgacagcgttgtcaacaattcaccgtctgcaaaacatgggccatgttcctcccccttccaataacagttcccctcctttgagtgttcactggcagcctcctggggcctctacacacctcactaacaattgtcaggacagcctttaggctgtcacccactttctggttctaacaccagtgtcacagattcaagcactcatttctggtatccaattctgttccacttattactgatacataaaaagtacctcaaaatacagtgacttaaatcaatgccaatccttaattttagtgacaaacctgtaatttgggtaggactatgctgggtcagtttatccctgctaggcccagtgttcgctggagtcagattgattcagggcttggggattaattttaaaggtggcttgctcatgttgggggcatgatggcacaagcaggcagctgtaggctcatccagggttcagtttctctccaggctggttagtcaatgggctgcctggcttcatgatagcatggtgcctgggttctaagagtgaacatctcaggagaatcaagtaggaactatctggtcattttatgacttagcttcagaagtcacatagtgtcactttagaaataattacccgtccacccaaattcaaggggagagggatactatacattccacctctggagaataaaattgtcaaaattttattttaaaaggagtatgttggattggagattattataattagtctcacaccactgaaccatttccctgttaaagaatgtggccttatttttctatttgtggataaacagtgctataatattattttagtgcatttctttggagaacatatatttacgtttgtgtaaccatctagaaccataactatcagatgttaggatttgtatatgattagctttagaagatgatgccaaacaggtttcacaactggatcacaggcatacctcatttgattgtgcttctcagatactgtgttttcatttatttaattaattactattattattatttttgagacagagtgtctctctgttgcccaggctgaaatgcagtggcatgaactcggctcactgcaacctccgcctctgaggttcaagtgattctcctgcctcagcctcctgagtagctggtattacaggcgtgcaccaccacactcggctaattttttgtatttttggtagacacatggtttctccatgttgaccaggctggtttcgaactcctgacctcaggtgatctgcccaccttggcctcccaaagtgctgggattacaggcgtgagacaccgcacctggccagatactgtgtttttttacaaatggaaggtttgtggcaaccttgcatctaacaagtctattggtgccatttttttttaaacaacaagcactcatttcatgtctttgtgtcacattttggtaatttttgccatatttaaaacctttaagttattatatatgctatgatctgtgattagtgatctttgatgttaatattgccattatttttgggtgccacaaattgtgcccatataagatgacaaacttaatggatagatgtatgtgttgtgactgctccatcaattggcttttctcccatctctgtctttctttgggggccttccctgagacacaaagatactgaaattaggccaattaataaccctataatggcctctagtgttcaagtgaaagggagagttgcacaactctgactttaaatcaaaagctagaaatgattaagcttagaaatcaaaagctagaaatgattaagcttagtgatgatggtatgttgcatattgagataggctggaagctaagactcttgggccaaatagttagccaagttgtgaatacaagttgtgaatacaaaggaaaagttcctgaaggaaattaaaagtgataatccaatggacatatgaatgatgagtcttattgctgatatgcagaaagtttgagaggtctggataggtcaaaccaaccatagcattctcttaaagccaatgcctaatccagagcaaggccctaactctcttaaattctgtgaaggccaagagaggtggggaagctacagaagaaactttgaagcaagcagaggttggttcatgaggtttaagaaaaggactatctccataatataaaagttcaaggtgaaacagcaaggtctgacggagaagcagcagtgaattatccagaatatctagctaagaaaattgatcaaggtggctacactaaacaacagattttgaatgtaaatgaaacagccttctgcaggaagaagatgccatctggggctttgatagttagagagggcaagtcaagggctggattcaaagtttcaaaggacagactgactctcttgtttggggttatgaaactggtgactttaacttgaaggcgatgctcatttactattccccaaatcctaggacccctgagaattacattaaatatactctgcttatgctccagaaatggaagaacaaagcctggatgacagtacatctatttacagcgtggtttactgaataatttaagcccgctgttgaggcttactgctaggaaaaaaaagattgctttcaaaagattattgctcattgacaatgcacctggtcacccaagagcgctgatgaacatgtacaaggagataaatgttttaatgcttgctaacgcatcattcattctgcagcccatgaatgaaggagtaatttagattatgaagtcttattatttaagaaatactttctgtaaggcagttgctgccatagatagtgattcctttgatggatctgggcaaagtaaattgaaaaccttctgaaaagaattcaccactttagatgtcgagaacattcacaatttatggaaggaggtcaaaatatcaagattaataggggtatatacccaaaggattataaaacatgctgctataaagacatatgcacacacatgtttattgcggcactattcacaatagcaaagacttggaaccaacccaaatgtccaacaataatagactggattaagaaaatgtggcacatatacaccatggaatactatgcagccataaaaaatgatgagttcatgtcctttgtagggacatggatgaagctggaaaccatcattctcagcaaactatcgcaaggacaaaaaaccaaacaccacatgttctcactcataggtgggaactgaacaatgagaacacatggacacaggaaggggaacatcacacacccgggcctgttgtggggtggggagagtggggagggatagcattaggagatatacctaatgttaattatgagttaatgggtgcagcacaccagcatggcacatgtatacatatgtaacaaacctgcacgttgtgcacatgtaccctaaaacttaaagaacaattaaaaaaaagagataggaatttttaagaaattgattccaactgtcatggttgactttgaggggttcaagacttcagtggtggaagtttttgcagatgcgatcgaaatagtaagaaaactagaactagaagtggagcctgaagatgtgactgaattgctgcaatttcatgataaaacttgaatggataaggattgcttcttatagatgaacaaagaaagttgttcatgagatcagatctcctggtgaagatgctgtgagcattgttgaaataacaaggatttagaatattacataaaattagttgataaaggcagtggcagaatttgaaaggattgactccaattttgaaagaagttgtactgtgggtaaaatgctatcaaacaggactgtaagctgtagaaaaatatttcataaaggcaatagttaatcaatgtggcaaactttattgttgtcttactttaagaaattgtgacagccatcccatccttcatcaaacagcactctaattagtcagcagccatcaacatctaggcatgatcctccaccagtaaaagattatgactaggtgaagactcagatgactattagcattttttagcaataaaatattttaaaattagggtctgtacgtgtttctttcaagacataattctattgcacatttttagattacagcatagcgtaatataatttttgtacccattgggaaatctaaaaaatttatgtgacttggtttattatgatactggctttattgaagtagtctgtaactgaacccacatatctcggatgtatgcttgtgtatgattttacaatcccactaacagtttatttccactcctcaaaagtacttgtgtttgtgtaggctaataatagctggcaattatttgttccttgtccttgagaaggagagtctgattctcttccctttcaatcagctctggccttgataaatttcttggcccagcagactgcaacagaattgaagttgtaggactttcatggctaattagaaattatgaaaaacccaaaccttgtgctttctgtttgtgcatcttgagatccccttgtttagagctacacgccccgatggaaatggtctgaccaccctgagatcatgtgctggaggtcttgttgacagtatggtcccagccttctagaacattttttagatgtctgtcacatgaatgaagttgtcttgagtattgcccaccagcccacccactagactagtcttgaatactgctaatgatttccaacaaggctgtgacagaagaatcaccagtgtaaggctgctggattcttgacacatgacatcatgagatagaaataaggaaacagaaatttaatgagaaagagataatgagatataaaattgaagtgctttaatctattaagttttggggtagttcattctgctgcaataaataactggaagggtatgttgttttagccattatgatcgctattttgctttagccattatgatgtacatgtggtaatagagcatcgtgcttttagtttgcatttcgctgacaattatagtgctgagcaactttccatgtttcgataatctttagtgacatcctgttcagtttttttcttttgccattttacactgagattatttttctttgtggattctttacattagattgacctatatagagttgggcttttaaaaaatttctcctttaattctgtttactattgctttattcatcttgaagcttgattaatggtcttatacagatttaggattatgatactttccagatatgttggccctttgcggcagttatcttttgacacagtgttttataataacgacacaaatctggtagccaaaacaataaggagctatatatttattacaagtcagtggactgactgggcaaatcttttggtcaaagatagattcacagatgcaactgcaattcgctggggacacttaggcaattcttccaagcttggcttagcgctctcataagttgcataaaaactgtgctccccttcatgtgtttttcacgttcacaagtctctcctatcatgttgtctggtagccttcttgaaatattctaactgtggtccctcggcccaacacacacacacacacacacacacaaacataaaccaggaagaaattagaagcacacgatactctttcaagcctttgctttcaataaatctgctaatatccttttagccaaagcaagtttgtcagtctgtacccaatcaggaaaaagagatgacaccattatttaagtagaagaagtttaatataaataattatgaagctatattaggagaacaacctataaagatgtaaagatagttaataggtgctccagggttgtgagaagatcaataaaggagggaaaacataatagagggtggtgttcttccaaggctaggggtccaatctcattagagaagctgcggctttagcttacttgatgacagtaacacacactgatgacatcttccagagttagttcagtcacctggtaatcaggctataactttcatgcacgtgaaggtgagctgagacttgggggtaggtatgcaatgagagttggaatgtcactatcgttggcaaacacaaaaaaagaacacaaagttcatatagaggaggccatgaagagtaagcaactagggcaacagagagctgaggctagcaagtgggcacatagaatcatgtcactgctgtgtgcatgaagcctgaagcatgtgatttccatgttaggagggcccctggaagcaaccttccaggatgcaggtaaacctaggctggtgggagattgcacagggtgcttctgtgggtatgaggctgggagcatgcaatatttatatcaggagagctgtgagaaatacagctctctcctgcagacaagataaaggcacatagggagagcagggtgctactaggaggcttggaacatgtggtgtctgcactggggaccccgagaagtcaccaggccaggccagagtcataggaccactgagggactaccactctggacatcggctggggcagagacccagcagatgtccacacatttatggccacagatagatagatcataaagcaggagcaagaaaaataaaaatacagaaaactcaactcaaacttagaagagcacgctttttcttcctacattgtctttctagtgacctctcctaacaaaacatcatgcttactgaaaaggagaaataaatacaatgatattgcagagtaggtactgagggtgaatttggagctaagggaccataaattgatgactaacacaggcagtcatgtggcaaagcttatattcagcgtatgggaaaattgactccatctctttagtgagaaaactgcaaaagcataagacaaagggcaaatataaacatagagcttaagtttttggtgatcaatcaaaaatgtaataaaccacaagtcagtccccagccataatgactcagaaaacttccatgtagaaaacatgctcatttctcgccttgatccctcctcacatttcattcagttacatcaaattcataattcaggatcttctgatcaacctcaaatccacgtatgtggttccttttgtgtagctccttatattctgcagaatttttgatgaaagagggatgttatctggacccccccaccacctgtaacttcaatggtgcaaaagaaagataactacctgatgcatttattgtagaaaattttactaattttctactcaagaatgagaacaacggccatatagctgtcactgtctcaatggtattctgaaatctagcttggaaaatgttggcagatattccgaattttggaatattttatttaggacttaattataataattgagagtagacctacaaatcattttcctccacatttcttggttctggttttttggacattcattttatttttattcttctccttaactacttctgaaaggacactggaaaatttgtgacttaatcaacttttacattctcctttctgcctatagaaagatacggcagagagcttttgtttttgcattttgagcaacatcagtccatttaaatccaggctggaggcatttttgacaattaaactcccttagaaactttgcgggtttccaataaaattgacttcattcaacaccattaaccaaaatccactcctacaattccctaacaaatatgctactcttcctagatacatgatcactttgcccataataagctgctatatcacaatgttctctagatttttgaaactgagatagtatcctatgcattgcatatttgagatggtatctaccttaattaattcacaagtcttttactgccataccctttattttaaatgcaattgcattctatattttcttttgagaagcttttgctctctggaatgtttggagattacattttcatatctaacatatcaagttctctttgctttataaattctgtaaattcatctctgtatgttctagtacagcttatcatatgtagcttttacgggccaactgaccctgtcaacattccattagaaatatgttttgttttggtcctaaccaactgttcactaggtatatttttctatattctaatttaatgcacatgattgttctatggtcatttcactactgcccaacacaggctgtaatgtttctggtcttcagtaattttcttaccattttctagcctttcctatcaattttcttgctagttttttttcagctctgtccactgtcaagtactaaaaccagtacatattttaaattttgttatgatatcactcctcttctgataccagtttctgtatcagttatctgttttatataataatgtttctaaatgcagtggcttaacaagtgaacatattattctttatctgtctacaagtgggctgagtggtgattgtattcatttctcagttcactaccacaatgctagtcagcagcatgtaggttagtttattgatcttggctgttctctcactcccactctcttgcctccttctttggaagctgtctgactattggctggactattacagtcttagtttggacaacttatctcttcccatgtgtttcttttagccacatgtttctaaattctttccagaaggatagtttgggcatattcttctgactatcacagacaagcaaaagagaaatccaaaacccacaaacacttcatcaaggttttatttatgttaaagctgctaacattatttttggctaagacaattaatagcagtaagcccaaatttagggctgggaaaatatactcgaacaaattagttaaatgaatttcacagtcacagcaaaggacatggatactggtggaaatgcacagttgaggttaccaatacaatcattcaattatacacctttgccattataaaatatacatctctttctttcttaatgctatttgttttaccttaaaattgaattttcatgatattaatgtatatagataaattttttgttatgttatttttcactcaatttcaatatttctgaatacaactgtaatttttaagacaacaaattgctttttttaaggccaataatcttagtgttttatgtagcatatttaatccatttatatttattggtattgctgatatctcactttttattttctctttgacctacctcttctgtgttctttttattccatttttgatttaattaattttgtcttattaatttcttactatgcttctaccttttcctatagatattacagcatgcattttgatgtattatggagtttaaaacaaacgaatattttgaccattctcacaataccgttagcatctttaaaactgttaagctctatcaactccgcacccacctcttgcatttcatgaacatgtatatcaatgtacatattttggccatcataggaaactgtaataattatttattaacatgaatagtaatttatatttatatagttactcttttcagtgctttttattcctttttacatttttacatttctatgtggaatagttttctttctaattgaaacacatattttagttttttctttttaatatattcctgctggcaacaaatactctcaaacttttctgaaaatatttttatttattttcttttatttattccttgaatctttgtttttcttggaacaccattgtttccccttcatttttgaaaagaattaaaaagtacagtgagttctcatttattctgaggggacctattttcttcctacaggatacctatctagtcaactacctttttaattttagtgataatttgttcatttgaggtattacgtggcacccaataattaagtagtgaaaataaaataccatagcaacaaaattaggttaaaaaatgtttaaaaattgaagtgtttgcctaaacttgtagagaaaggtatcatctttacaaactttttgagtcatttttttctttcagtttactgacagttaaatatcatagttgcctccattgtaagtatcatatcattatacatactttttggaaggggtatttctgaagctctatggtaataaattgcatgttttgtgatcatgtccacttgatatgttcataaaagttacagatactcttgccataaatacatttaaatatcaaattttatacatacacagaaaattgtgtatacattttcagtgagttcacatatctaactaaattatacttaaataaaagtacagcttgggctgggcacagtggctcacgcttgtaatcccagcactttgggaggccgaggcgggcggatcacctgaggtcaggagttcgaaaacagccttaacatggagaaaccctgtctctactaaaaatacaaaattagccgggcgtggtggtgcatgcctgtaatcccagctactcgggagacaaaggcaggagaactgcttgaacctgggtggcggaggttgcggtgagccgagatcgcgccattgcactccagcctgggcaacaagagaaaaactccgtctcaagaaaaaaaaaaaagtagagcttggacaagaattaaactttgactaccaattattcaactactcattgttctgtagcacatttactcaattaaataaactacaagagtgtaatttaatagatataattttttcttttaggaataatctctatatattttctctatataattacagaagtaattattgttttattaaagtattttcaacatttatgaaaaatattaatgcatattgacatggtagaaaagttatgttttgttgcattatttaaaaaattaaattattttctctattttggggcatacaatttatagatgcctaaaaatgttgcacgtttaaaaaaaagacaaaggttattgaataagtggaaaaccaaaacacagatccattagacatatagtaaataaacatcttatagcttttacatcaacagaaattacaattgtgctgcttttctgttagatggggacagatttctatggcatacttgctacattttcacctaacattttctttgatcaatattcatcatttaatagaatactttacgtgaatcttcactttattatactgttcttttaccaagttattagcactttggaagaatagtgttgttaattttgctttcggaatctcctacaattagagaacatagcataactctttttacaggttaatcaaccaaaacgttatctaggtaagatcagttatgaaattaggactgtacattcctgaattcaaatccaatgactagcccaccgtatttctaccatgattcttagcaataataacataaagacttcattaaaacacataaaaagacaaatgaaaaaacacaccaaagaagccccaacaccatcaaaaggaggttggttaattctgattgataggttcaaacagcctttgcacacaattttcccaaataaaaaagtccaaagtctttaagacttgcaaagcccttgattgcttctctggtatccttgtcattaaccccttcttttccaccatccgcactaacattttactctgcggttatagttgtttttaggtttcaaaagtttaatgtttgttatctctttctattgctttcccaatattactcttctcttacccataaagtagcaataaactcactgtattttgtgtttttcattttcttcataactcctacaaactacatactgagtgaaggagaaaccatgtcacttttgcttgtcattgtatctccaatgttcagaacagtaatgggtatatatttgttgaataaataacataaacatactgctagtgagtctgatatttccaatctagagcattaatatagctatgtaaataagtttccctcattgatttcagtgcctttatatttagaaactacaacgattctgctagagagaaaaaaaattacttgtactaaaacacacattttcatagaaattctctaggatcctctctcagaaaaacatctattaaacattggatgctattttccattaatgctattttaggagtgatagactttagaaaaatttctagagtaacagaacatattattatatgtagtagcctctacattatttaagtatttgatacaactgatagaacaatttgaatatcatgtttaagagggtttaaatgtctattcatataatgttctaatgctaaaggctaagaagatctggttgctaaaccaactgagagcagtattatcttgaaatatatatcagttttatagcagcataaggtcagactctagctatgataactttttctctagtgatccattgagggcagtgtaagggttttatgatgatatcttcattctccgtcaatcactccattttaaacctagatctttggatatttgctaacaagatttctttacaattagaatcacactttaagattctgttgtgacaaatatcttaaatataaatatttgtaggatagtactcttgtaatctaatgtggttttgtacccgaagtcttctaaataacttaattttctatgtaaccatagtattaatataacaactctgtactacagtaatagccttttaaaaatattcaaaatatttcatgcctgtagagggaacaaataaaaatatattcaaattaatatcctgttgtgatcattgtaatgaacatacttaaacctttgcttcatgactcaggttcatcattttgcttagtgattttacttttctctagagtatgtgtaagtgctgtgaactcagcataatcttgggtttatctcttcctaaataaatttcacctacagccatgatttaattaatgtgccaccacattattattattgtgtgtgtgtgtgtgtgtgtgtatgtctgggggaattgccttttctaaaaacagtgtaatgcacattctttaactctaacaaaactggtctccatatataaagaatacaacatcggtggtattctgaagaaaggctagagcagtatagtcaaaatgcaatgcaggatacattgaagtgtccaaagaataaggcaggtggggcatctttatgaaactgttaccaatcagaagatgagcacagagtggagtctgtgtcagagaggtagtcctgaaacagggctttaaatgttgtggttaagaagataatatgtatctcaacatttcaaaatcaggtttacataagctactaaatattcaccagggacagtttatccttaaaccataaatctatgccaagtatagttcataaaactgctatagggaagttctcatttgtctccacaatgtattctgagaaaccttactgtacagcagattgttataaaaattttatattttctcataggaacaatgttataatttgatgttatatggtagaccaagcatttaataaatcatagacatgactgaaaatatgtctgaaagtaacatacaactacgaatttgtgcaataattttaaatgataaaattatgcttggtgttctgttcaatgaacataaatgtactatatactctgataattcacaggccccagtgaatcataaaatgaaagcagaatatataaaaatacaattctgctacattataaatttgacctatcataagattaatttaattttcctctgtgattttgtatattgttttctctaaggacctcctcattctattactacacccccatacacaactgaaatagttcctatattcaatgtaaattttaatactcaaatccatcccacttacagtatgattaaatgttgaaactgagaagcatctcagaccaaagtgtggaaaagatcagatggttatttggaaaccctatttctaaatggtagagggtgtgcctgagctactactgacatacgtttgtatggatgttttgtttgtttttgttttgttgtatttttggaagtcaattgtataaaggaaaaaaattactctttgagcaattaaaaaacacgtggaagaatctccataactctttctctctgttatgttcaaggaggtgtcatttcagatactgtgcaaatgtatttattccaggccttaagtatatttctttaaaattttggtcaatatgctcttactgttttttttagctgtttttatctacagtatcttcagtattttctgacatcagctattcccagtctcttatatctttaattttatcttgctgaggcaatttggctaataagcatgttcaaatttcacctgtgtcccaatgtaaacacacacacatacacacagaaaaacaacaacaaaaaaattttaagaactcttaccttttcccagacatcagtttctgtgtttataacaaaccttcaaaggatgtctgtgcacgctgccgctgcctctgcttcccattctcatgacggtggagcttcctcccctctgctttctggctttctcaaatgttttttaaagtaagtagctgacaaagtcaatcagcctttgccattcctcctctttttctcctctggaacatgtgacactgtcaacacttcctggaaatcctgcactctctcacgatgtgctcttgtactcctcctgcttttactgctgtcttctcagctttttcctactccctaacacagtttttgctctaatattctgcacttgtttatcttttccagcacagttatcttcaccaatcttatttatgcacagcgtttttcgtttcttcacagagaaagtttcccaattgtccatccgtttgctgacttctccaggactcacattccgtaatacctgctgggaattctgagctggttatctccccagaagttttctgccctagataagctacttgctttcttcccgttttatcagtttcaaacctaactgctctctaaaattcaggtgcgatatcaacccggctgtgaaataccccagtttcaataaatgctccttcacttgtgctgctttctacctacatttagaacctctcacatctattcttacatttgtttactaaatgtgttcttatcactacaacagtattttcaaatttactgaaggaaaagaaacaattccgaaacagcaaagttattaaatattcagttagaaactattttggtaatatgcatatctatatctatatctatatctatatctatatctatatctatatctgtgtgtgtgtctctctctctctctgtgtgtgtgtgtgtgtgtgtgtgtgtgtgtgtgttaaaagttagacttatttccaggatttttttattagaatttgtgaaaatgctaacagtgttaaaatacagtgaccttaaaagctaacaatatgacaaggttggcttcatttttagaagtaggtacactgtctccaaagggttttatttactacagatatttggtctgtatatttagtgctgaattgtatgattctaaacattaaaatgtaagcagcacatttaacataaaaaggaaaccagctctaggtgagatacatgtgtcacagagattctcagttattaatgttgctacaaaatttccattctaatagcaccacaagaatccaggtatgcataaggcagtctccattaagaatcagtagcaatcttatgttgcaaaacatagggtgtctttagttttaatatgttaatttttatctcaattctgtgatatcacttcagtgtggagaaaactgaaaaaatacacatcaggttcactgctgattaaaagcttttatttacatttttacctgatttttcattctaacctaatatgctaattcattaaataaacttcatattatcatattgtgaattattatcagtagcccagatggaatcttcatgtgaattcaagataaaggcatcctatctcaatatgctttacttccaactgtcatactgatttcgttggaacatacatgtcattgctatctatcaaataattgttgcaacaaatatataaatacattatatttgtgaatgaatggcagctccttaaactgtggcatgcttgtgtaatacacgacccccacaacagtgtgtgctgtgtgtacaggccatggactgtgctacggtttgcagattaaatgtccctgagcttcagttacctaatttcttaaatgagaatggcacctatctcatgactttttgtaagcatatggaaaggtattacaacgtgaagtataaaatcattattcaataaatctgttttctgtgtgtgtgttattttttaacctatacttcagaacacactgaagattactttctctaagaatggtgtcctgatgctctcggccaggggtcagtacgtttttttcctataagctaccacatagtaaatacattaggctttgcaggccgtctgttctctgttacgactactcaaccattgtgttataaaagaagctgtagataagacagcatgcaaatgaatgatcgtgattgtgttctaataaaatttaatttacacacacaaacaaaaatagactgtatgatttggtccacaggttatagttactgactcgtcatgccagcccacactatctcattttcaattttcaatttttaggctttgattcagaaaaaaagtttcaaagtaaggaacattaattttctcttaaatctcagtttgtgcctatattaaggctgaagttagagaaagcttatttgctgaaggcctctttttcttgactgtatgtatctctgaagttttttactttcctttttccttttctctttttcttgactgtatgtatctctgaagttttttattttcctttttccttttctcttgtctaaactgatgtttttcttcccttcttttgggaagaaaatactttttttttctattgacgttcattatttaggcattattccattttttttcactttttttctcataagtatatgtttataaatctactttatgtaagcaactttattttctaaagttatatacttttttaattaaataaaatgctcaaggcagcctttctcatattctggggtgcccagcatctatgtcataccttttgtggcctttcaaaattcctatattctgatagtctatctccttatgaatttttgctcaagtgaaattatcaaccctattaatggtcagagctattgttctacaagtcaccattaactcgagtttgaggcctgaagcaatctgtgaaagaaggccttggaacaatgcagttgttctaccgtgtatcacagaaaagctaatttagctttcataatgaaaacaagtatcagtgtcctgaagtttcccagccctgggcagggatgcgtattcaactccatcaatgtgaaaataaaagttattttgctatttttaatagcgtctattactcaaagagtatttactgcttcttattcttccttcagagctggtttatttatttcagtcttattcttgctatagagaatctaactaacttttttttaaaaaagaaaactgaagtcaaaccaataatcttcaaagacatatgaaactactgtatgccaagcagtgtggcatcaagtacaacctattttaaaagttaagaagaaacataatgaaagatttgaatgtaccacctacactatattattgattatgttaacccaaagtacatactatgtagctagttaagtattacaactttgttttaaaagaaaagggtcaggcgcggtggctcacgcctgtagtcccagcactttgggaggccgaggtgggtggatcatgaggtcaggagatcgagaccatcctggctaacacggtgaaaccccatctctactaaaaatacaaaaaaaaaaaattagccgggtgtggtggcgggtgcctgtagtcccagctattcaggaggctgaggcaggagaatggtgtgtacccgggaggcggagcttgcagtgagccgagattgtgccactgcactctagcctaggtgacaaagcaagactccatctcaaaaaaaaaaaaaaaaaaggcaatacactaaatatgaatttaagtaaaattcaaagcagaatattcttttattagaatttccaccaatacactcaaaggaattcaaagactcatgaccacaaaacaagtttgcattaattatcacggtgtgatatcagtatttttaaatatatacatgcccacttatgatagggttatgttccagtaaacccaagctaagttgaaaatatcataaagttgaaaattcatttaatacatctaatataccaaacaccatagtttagcctagactacttaaacaggaaatttttcttgtcctgtttgcaggctttccaacaagggtgtctcacttactcagccggcagctctcaaccccttatgggagagtaagcgcgcaggtgagtgtgtgcaggagccggagcagtgcttttgggtgctggcaggagcaaaactctgtgtggtgcccaacagcagcttctggggggagttcctatgacccccgaagccccagagggtgtgtgttacagtgctcttttagctttgccatccacagatggcttaagtgttaaacagctcagtgggccctctgccttttcataagggcagagggtcagtgtggcagtctttagtgtctgcacctgtggcacctgaactcttgttcagcatccaggaaaaatcaggtcatatgaatgaattgaagggtggtgaatacagaggatttcattgctgatgaaagtggctctcagcgggaaggggagctggaaaggggatggagcaggaaggtgatcttcccctggagtccagccatccaggccaaactccactccaaagcaacactgttaagctgtccctctgaagtcaagttgcttctctccaacgtccaaccacagttctgatgtccagctgcctctcctcttctcccctcctcttctcccctcctctgctctctgacagttgggtcagggattttttttttttttttgagatggagtcttgctctgtcatccaggctggagtgcagtggcacaatcttggctcactgcaacctctggctcctgggttcaagcgattctcctgccttagcctcctgactgactgggattacaggtgcacaccactatacctggctaatatttttatatttttagtagagacagggtttcaccatgttggccaggctgtctttttttcctgacctcaagtgatccgcctgccttagcctctcaaagtgcttcaattacaggcatgagccactgcatctgtcccctgggtcagggtttttatgggtacaggatgaggggaagggcaggccatgggtagttttggaaaaggcaacattctagcaggaaaataggaatgcatgttctcactctgggccacaggtcgaggcttgaggataggactttgccagggaccccatgcttttcgcctagaatttctctgcctcctttccctattgctaccataaacgtgctgagaacacttactttagtctacaactgggaaaaatcatctaacacaaagctattttataaaaaagtgttgaatatctcatgtaatttattgaaaactgtactgaaagtgaaaaacagaatggttgtttgggtactcaaaatacaatttctattgaatatggatcatttttgcaccatcttaaagtcaacaacgattaacttgaggaccatctgtatggattaagatatacataaccttggtttagaatcattttcatgctctactactctactcctactttttgttttctctgagtgggtattattccagaccatgtcatagacctgctcagctcagtgtttccccctttcatggattacactcaattatagcaaaaatttgttcccacatttgtaaaaagtacagctttttgattaattcccaggtaaataaaaattgcaaaatacatgcaaaagaaaaacaggaattgaaaacagtacctggaaaaattctaagttacctgcaatcgctatctacagataaaaatatgataataaattttatttttttgtattaacttctctgaaatgagtgagtattaatcttagaaaacataatcacaatcttctatgataaaaatttctttcagctctgagtctataaatatcaactaaatgcatggaagtactgtaatttctagaaggggctcacaaatgttgatcctattcaggaacttttgggtcttcccaagttctagcgggaaatatttagctgttgttactgtgcctagaactagttgaggatagtctgaaactcaggcatttgactgcaagaaacttctagcagctctttccacaaagacattttatcattggctttggaattaattgttatagtgtgaggaccgtagggatgcaaatgtaaagtcactttcactttcagggactaactaaagttctgttaccaaagaacaaaaagttacccattttgcttgtaactgaaataatataaccatatccaatatatttattcattgtacaggtaattattaggcacccaatatgtctcaggcatcgtttaggcagttgagatacgtcagttaaagagaaagaaaatgcataagaaaccctttattgaaggctacacaatccaaacatgttgagggttaaatgttactttgtacaatctttcctcacactgtctacctgctatatttcactaaagaacaatgagaatttcttgcttttctagtttcatgttttgggaatagctcaatttttcagcaatgcagaagtcattgacagacaaaaatatttcgactacatgatttattatctgtcattaaatgaaacacatacattcacaaaattgttgttcttgtctcatgaattttcagattaacttttgggtttctttactgttactgcatatatattttctcttagatttctatctatactaacaagaagactaacttttaattttcagagaaaaactacatattctctataaatattttcaagagctccatttaccattaatatgttatacttaatagcctagcctggttattgaatatatatatgtaattttactgattagaattgctttaggtcagaagttcttcttttctgaaagtgcatcggaggatttctaattgatgagttccaaaatttgttttatattcctgcagaattttgccaacacagtgaatggagcaaagggctgaaacagccatagctccatgaagctcagatgacacttctgcaaaatgagcttcaattcagttacatttacaagtaagaattagttttctggcctttggctccagatgatggactcctataattagactttaaagttttgcatgtgattaaatctgcaatcctttgattcccctcaccaaagcacgttatacaagtttttaaacctctctctatttgccttcaagcttttgtgcttttctccttatgtaatctcaaaacagtttaataggacatctattttgagtcctataaatataaataccttggggagttttttaaaaaataaattagataaaaattagtatgatgactactctttctctcctttttaaaaatgggttaagatactttgaaaaacttttaaggtttataaagtaggtatagaagaggaaaagtttagagaaatcttacactctaagagggagctcatttggcatcaaaagataaaggcacacagtcctgccaaaattagaaagggacaaagccaataaagtaaaatatcttttctttatgtatagcccctggcatattatacttgcttaggagatgttcatttagttataattatagttatattataattatagataattatataatgattatataatttattatgataatgaaaatgcctcagagctggtgaacaagtaatcactggattaagatcttcttggaggtgcctccatttctaacaagtccttttatttttatgtaacataaattatgcaagaatatgtgcttaataaaacaaaggcaagtcaaatgaaagtaaaatttcacattatattctttgattatatatatgtgttttttaaattttattttggtaagatagaaaacatacaatttcaaccattttaaagtgttcttctttgtctattgtaacaatttttgacttgaaatctattttttttaagtaagtgtaggtacccctgctctcttttgagtattggcatgaaatatcttttaccatcctttcactttcaacatagggttgttcttagacctagtgtgaacctcttgtataagcatgtagttggagcctgctttttttatccataataattctccgtgtgtgtgtggtttatttatcaatcagtggacacttggttttattctaccttttggctattatgaataatgctactatgaacatgagtgtacaagtatctgtttgagtcactgccttcaatccttttaaatttatacccaaaattggaatttctagttaatatagtaattttattttcaatatattgagaaaccaccatactattttctatagtggctgcatcattttacattcccacctgtagtagtgcacaaaggttctgatttctctacattaatgccaacacttgctattttccttttttgatagctatcctaatgggtgtgaagctatatcttagtgtggttttgatttacatattgctgatgattagtaatgttatttgtttgatgtactatggttcataatactctcttataatcatttttatttctgtaaaatcaatattttcatttgtaattgtagttgtcttctcttttttattgttagtaaacctaacactttaacaaatgtatttttttgcgaagaaccaactcttggtttcgtagattttctctgttggttttctgctgttttcctatctctggaaattcccataaaaggaatttttatttccttcattacactacctttacagttactttctcttctttttctagttccttcaggtgtaaagttaggttgtgaatttagatctttctccttttcttttttatttatttatttctttaaaattattctttaagttctgggatacatgtgcagaacatgcaggttggtggtttgctgcacccatcatcccgccatctacattagatgtttctcttaatgctatccctcccctaaccccccaccccactgacaggccccggtgtgtgatgttcccctccctgtgttcatgtgttcttatgttcaactcccacttatgagtgagatgagtgagaacatgtggtgtttggttttctgttccagtgatagtttgctgagaatgatggtttccagcttcatccatatccctgcaaagcacatgaactcatccttttttatggctgcatactattccatggtgtatatgtgccacattttctttatccagtctatcactgatggacatttgggttggttccaagtctttgctattgtgaagagtgctgcaataaacatacgtgtgcatgtgtctttatagtagaatgatttataatcctttgggtatatatccagtaatgggattgctgggtcaaatggtatttctggttctagatccttgaggagtcaccacactgtcttccacaatagttgaactaatttacactcctaccaacagtgtaaaagcgttcctgtttcttcacgtcctctccagcatagttgtttcctgacttcttaatgattgccattctaactggcatgagatggtatctcatagtgatttttatttgcatttctctaatgaccagtgatgatgaggtttttttcatacgtttgttggccacataaatgtcttcttttgagaagtgtatgttcatatcctttttgatggggttgtttgttttttcttgtaaatgtgtttaagttccttgtagattctggatattagccctttgtcagatggatagattgctaaaattttctcccattctgtaggttgcctgtttactctggtgaaagtttcttttgctgtacagaaactctttagtttaactagatctcatttgtcaattttggcttttgttgccattgcttttggtgttttagtcatgaagtctttgcctatgcctgtgtcctgaatggtattgcctaggttttcttctagggtttttatggtttaggtcttatgtttaagtctttaatccatcttgagttaatttttgtataaggtgtaagaaaggggtacagtttcagttttctgcatatggctagccagttttcccaacaccatttattaaatagggaatcctttccccattgcttgtttctgtcaggtttgtcaaaaagcagatggttgtagatgtgtggtgttatttctgagggctctgttctgttccattggtctatgtgtctgttttggtaccagtaccattctgttttggttaccatagccttgtagtatagtttgaagtcaggtagcatgatgcctccagctttgtgctttttgcttaggattgtcttagctatacaagctctttttttgtttccatatgaaatttaaagtagctttttctaattctgtgaagaaataatagacacaataaaaatgagaaaggtgatatcaccactgatcccaaagaaatataaactaccatcacagaataatataaacacctctatgcaaataacccagaaaatttagaagaaatggataaatttctggacacacacacccttcaaagactaaaccaggaagaagtcgaatccctgaatataccagtaacaggttctgaaattgaggtggtaattaatagcttaccaaccaaaaaaaacccaggaccagatggattcacagtcgaattctaccagaggtaagaagaagagctggtaccattccttctgtaactgttccaaacaatagaaaaagagggactcctccctaactcattttatgaggccagcatcatcctgataacaaatcctagcagagacaataaaaaaagaaaatttcagctcaatttctctgatgaacattgatgtgaaaatcctcaataaaatactggcaaactgaatccagcagcaatcgaaaagcttatccaccatggtcaagttggcttcatccctgggatgcaagtctggtttaacatacgcaaatcaataaacacaattcatcacataaacagaaccaatgacaaaaaccacatgattatctcaatagatgcagaaaaggccttcaataaaattcaacaccccttcatgctaaaaactctcaataaacttagtattgatggaatgtatctcaaaataataagagctatttatgacaaactcacagccagtatcacaccgcatgggcaaagctggaagcattccctttgaaaaccggcacaaggcaaggatgccctctctcaccactcctactcaacatagtattggaatttctggccagggcaatcaggcaagataaagaaataaagcgtattcaaataggaagagaggaagtcaaattgtctctgtttgcagatgacatgattgtatgttaagaaaaccccaccgtctcagccctaaatgtccttaagctgatgagcaacttcagaaagtctcaggatacaaaatcaatgtgcagaaatcacaagcattcctatacaccaatattagacagagagccaaatcatgagtgaactcccattcacaactgctacaaagagaataaaatacctaggaatccaacttacaagggatgtgaaggaccttttcaaggagaactacaaaccactgctcaaggaaataagagaggacacaaacaaatggaaaaacattccatgctcatggataggaagaatcaatatcgtgaagacggccatactgccaaaagtaatttatagattcaatgctatctcgacctttctttttaaatgcaagcatttttcaactataaaatcctgttatcactgctttcactaaaatccctaaattttgatatgtttcaattgtcatttatttcaagatacttttatacattctactttttcctgtaatttcttctttgacccattcagaagggcactgtttgattgtaacaaatttgtggattttcctagtttcgttctgctttgatttctagtgtcattccattgattagaaaagacactttgtataatttcaatcttttaaaatttattgaaagtttttttgtggcctaatatatgatgtaccccagaaaatgttccatgtgtgcttaaagaaaatgtgtttttctattgctgggtgcagtgttctgtatatgtctgttaggtccaaatgatctacagtgttcacgttcactgttttcttactgatcttctgttatgttttttcatccattattgaatatggagattgaagtatcctactattattacagatgtttatttctccgttgaatactgttgatatttgtttttgatatttagggagctttgatgtttagttcatatatgttggtgattattacacctttttatgaattcacacttttatcattataaactgtccttctttggctagcgtaacaatttttgacttgaagtctatttttttttttttttttggaaataagtgtaggtgcccctgttctcttttcggtatttgcatgaaatatatttgaccatcctttcacttacaacatagatttattcttagacctaatgtgaacctgttgtataagcatgtagttggatcctacttttttatccattctgccaatatatgtcttccgagtttagagtttaatccatttacatttacataattactgataggaaaaaagttactattgcaattttgtttgtttttgttatgtcttacagcttctttgcaacttcattgtctttcttattgccttcctttttgcttatttttttaatgacaggtttttattcccttctaatatcctattgggtacattctatagattttatatgtggggttaccatgggggttacatattgcatcataaagttatagcaaaagctattttaaaatgataccaactgaacttcaattacatagaaaacactacttctttaccactctgcaccccccgatgtatgttactgatgtcataaattgcatctatatataatgcatgctccttaacatagatttataattacttttgtgtttctttcttttaaaatctgtagtactattacgtgtgtggttgaaaagaatgtattctgatgccattggatggaatgttttatatatgtctgtctattatgtctatttggtctaaagtgcatttaaaatccagtgtttccttactgcctttcatttggacgatctatccattgttgaatgtcaggtattaacattacctataattattacattgctattttttctccctttagctatgttaatgtatatatatgctttgatgttggctgaatatataatagttttatcttgtgataaattgaccctttgtcattatataatgacctactttatctgttgtgatagtttttaattttaagtattttgtccgatgtcagtgtagctactcctgctttcttttgattatcattttcatagagtacctttcttcatccctttacttgcagttaatttgtatccttaaaacggaggtgactctcttataggtagcatatggttggattttatttttggttgttttgcccccccccctccatttagccactctgtctttttattgaagaatttagtccatttgcaactaaagtaattattgataggtaatcgataaagacttactgttgctattttgttaattattttctagctgttttatagattttttgtttctttcttcctctcttcctttgtgatttaatgattctctatattggtatgctttgaatctttttcccttattttttatatattcaccgtagatttttgctttgtggttgccatgaagcttacataaaatatcttacaacactctattttgagctgataacaacttaacttagatcatatatatgaactctacactttcactaccccccattttatgtttttgatgtcacaatttacattttgcattgtatattaattaacaaattattgtaactatagttattttaatacttttgtattttaacttttataccagttattataaatcattcacatgccaccattataatactatcctgaatttgattgtttacctttaccagtgagttttatgctttcatatgtctttaagttactaattagtattaatttatttcatctcaaagaattccttttagaatttcctgaaagtcacatctaatggtgaagaactccctcttcttttatttgtgtgtaaaagtttttatttctccctcattgctgtatgaccgcttagcttggtaaagtattcttggttgagagatgcttttttttcccctctctttcaacgctttgtatatattatctcactctgccctggcctgtgaggtttgtgcagagaaacccactgatagccacatgagaattaccttatatgtgattagcttcttcccccttgctgctttcaaaattcactctttttctttgatttttgacagtttgattataacatgttatgatgcaatcttctttgggttgaacctcattggagatatgtgatcttcatgtacttagagttccatatccctctccagatttggaatgttttcagtcactacttttaaagtttttaaaaacttgttaatttctctctactatactgctaatgttagctttcttgacatcttataaatctcataggcttttaaaatttctttttttaaaataactttttcccttctgggtaatttcaaacaacatttccatgagttttcttattcttctgtttgtttgatcaaatctctacttatgctttctattttattttttaattcagtcattgcattcttcagttccaaaatttctgttgcgttctttttaaaaaatgttttattaatgttgtttaagtttctcattgtgttcttgtattatttttctgatttcattaagttgtttatgtcctgttgtagctcactgagcttccttagaacaattaccttgaattctttgtcatccaatttatgtatttcaatttattttgaaataataattcaaaagactgaggatatcagtcttttttctcttaagacatccaaatgattggaggtatcaatcaatcattatgcctagttgatgcataaaattaaccatcacaaatctaccccttgtcaacttgacacccatacatgtttccctaagccatagttaatttctaaataaggataagaggtaggacatacttatatttaacatgaaacaattcaaaatgcactaactctttatccaaaaggtaatccaaaatgtataggtgttgttcactctcttccttggtatcctgtaacttaaatattatgatgtaatcttaagaacacttaaatactatgatataatcaacttatataataaggaggtaatagagaaagaaaaatacatcttctatgaacacacacaaatgtgtccataacaaaataagaaaaatatccttatgacgcttatagtccttgcttctggaactggtcacattgttgtagttggtatttataaccaccttcttccattatccattcaatattccctttgccttcagcaagtacctcagctgatgatggttctttatttaatgaagtaaagggttattcctgaagattccaagtcattagtagtcctgtcttaattgggttgttttggtttgttcttggctttaatcacaggacacagcaatactaagaaatatctcccatattccagacattttctttcttattgccaatgtgaaatagtagtccaatttcccctttgtaagcaggatcaaaacattgtaactctcttcttttcctattgattcagagacatgaagatcccaaagtgggtgagtaacagtcttaactttcagttaaatagtgtaattgttgtgtcttgttgtagaagcatttctccctttgaagctaagactgttaggccagcagagcataaagtcatgggaacacaaagcagaatttttctagtgggccactaggagtagcagtgatgccacagccatttgcaccccatgattcctggacctgtgaatcctggatatgggggtgtaacctaccacatttggcagctgattgacctgagagagttacaagtacagagaatactcaaacgcatcctgttttaattcccagtgtcaacattactttgtaccctcactgtcagtaccctaatttagatctttattgcagtaggaataatttattacagtagtccctaaattatttacttcttccatctcgccttataatttcttgagcatttattctacatgctgctattttacatatcattccttcttaaaattatgtaatattcctgtgttcacaatacaaagtttacataattttttcaaactttcaattacatgaaaaatgacctctatttgccttacagttcaaaatatgacattatacaatgcaaatgacaattatgcaaaataattttggctagataaacactttggcttaaaaaatataaagatgagtttaaatctcaagctacaagaagcataaggacacagtttgaccttaaccatcttttgtcttggctctctcatacagagctctgcttctttctgaatgtgaacttaactctttctcactgatgatagctgtctccccatgggggtaatataattaccaaccactctagagccatacacttcatagtttctgtcactaggcaagaaaagactcttttttcacctcataaaattctggaatgcaatctcactgttatggtctagagtcatgtgccaatagaagattcagctcttgcagagacttcatatttgaaacagaaacagacagaaagcaggagataggggaggtaagatcaaatgagagttaaaacacaaacacaatctttcaaatttcttttgactttttctaaacaaaacctgatttctccagattttctgagacatacaaaatgcatttcaatctgtgttagtgccgtgtttctcaacttcaatgtctattccgtgttcccattcgcacatccaagttttgaacttcctatatggggttcaagtctactacttctacaaaatgttttaaaagcaatccagacttcaggacttttaagttattctaatgacattttttactatttaaaaagtggtatatactaatttctgttcctgtttacatttattctaatattcatttttctgattatatgaaaaatatagcctcatcaatgtaataatcaaaatttacaatacctagtaactctagtgaagaatgaatttcccaacactaatttcttttgctgttactgaaatcataaaaaaccaggcattcaaattttgagaactcttgaatgtcaaatttagaactctaatatgaaggtgttaagaatttgtataatttttccatgaaaaatcaacaataattaaaattgaaattatgcttttggaggattaatgtggaagtgcttttttgattagttaaaaatcaaagaaacgaggcaacaaaactcaaaagatgattttattgcaatcctattttcctattttgattttattcagtgtgattcttcttattcaaaaaaaacagtttacctaactgcagaattcaagacatgatttagacttaaattaagcattttatttttattttaaaaaattaaaaatatggggggaatagagagatgtaagtcaaagggtacaaagtttcagtttatgtcagatgaataaatctagagatctaagtacagcatgaggagtatagttaataatattatactatatactggaaattttctaagagaatagattttaggtgtccttcgcacaaaaaaggtaaccatgtggatatgttaattggcttgactgtagttatcatttcactatatgaatatatataaaaacgtcatgttttatgcattaaatgtatgcaataaaaagaaaaaattaaattatttaccacttttatgaaggccaaaaacttcttttcccactctggttgctctggatagtgacagtttttagttcatcaattatatgtatatgtaatgtttccgttttggttctttatagtgaagcaaaaattcaagtaaatacttttgaagcaaactatgtatcttctaaatttttacaattttataacctattctttttgaacgatttactgcttacaagaagctgaaaaaataatacagagggttttcatgcacatttcacgcaacttcctccaataataataatagcttacatgacaatagcacattgttaaaaaatggaaacttacattgaggtaatactgtgaactgaggtacaggttttatttgaatttaaccagtttagatatgcacttttatttttagtgcatagttctatgcacctccacctcccaggttcaagtgattctcctgactgagcctcccaagaaactgggactatagacacctgccaccatgcctggttaatttttgtatttttagtagagatggggtttcatcatattggccaggctggagaattttttaaacattattttcaccaaacttgtttctttgctttgatcctgaagacattaccttttcagatggctttatacatagattttgctttatgtggaacttttagatcatgggtttggactatgctgtttcagattattgtgctaacaatgggtttatcttgactatgcatataatttaaagggaaaaaaaggaaggaacatgtagaccagttgactatacatggttttatattgggtcctctactaaaaactttagaatataattttgaaagaagttagggcttgaaagagcttgaccagcgtataaaatgctaatgcatgatgttttataagtacaaactcaactgaactttatttattttaatttcaaattttaaactttagattcaatcagcgcacgtgtaggtttgatatatgggtatgttgtatgatgctgaggtgtggggcatgattgatcctgtcaccccagtagtgagcataatatccaatatcaactgaatagtaatacaagacttgccaagttgtctaaagatttaaaagatgataaaacataggaaatggacccagatgagtctattagaacacaatcatatacaattgaaaagcaagctcttagttggatactttcacagaaaaaccagtgaagaaattctaccatttttgaaatggtaaagtagttaccataaatagtaacacattcttgttcctgaaacaggtctgccaggaattattcttgaaagagctcttattgattgggcaagactattacatagatattgaaacaatgctaccaactcctgtcatagcaaatatcttcctctagaaattaaaactaataaactgaggaaataatataagttgatgaacctatgaaacatctaccagtgaaaacgaataaactaattaaaaacactatattgatcaaatacaatatgcctttgagtatatatggcaaccagacagatgtatcctctgaaagagtgataggttgatttttgtgtgacaagaggaagagagaaagggtgaggagggagagagaaaaggatagtctgggggtgatattgatttggggaaaagaaaattattgctcagacacattgacctgaaagtaaaaccagatgtacaaggaaaaatagaaatagaatgaaagtaacaaaaataataagaatgagctgtttgaaatcaaggacaaaggatgttttaatagcaagtgttagaaataattgattacactttatttatttatttgtttatttatatttatttatttatttatttgagacagagtctcgctctgtcgcccaggctggagtgcaatggtgcgatctcagctcgctgcaacctttgcctcccagattcaagcaattctcttgcctcagcctcccgagtagctgggattacaggcaagcgccaccatgctggggtaagttttgtgtttttagtagagatggggtttcaccatgttggccaggctggtctcggactcctgacctcatgatctgcccgcctccgcctcccaaaatgctgggattaaaggcaggagccaccacacccagcctatcttcactaattttaccaggcaactctttcaaatgatattaagtataaatagacaaactgagctttaaagtttaagaaggtaatatgttgcaaactttaaacattatgaattcatgtatccttttttaaaataagtcttctaatacctaataatgttacttatctttggcttaataataaaattataaattgactaagatggattgagcatttattccattttaaaaactggacactacttagtagatacagattttattcttattttactcatgaaaataatctacctaaaatagaaagaaagttgataagtagtaaagaaaggactcaactttggtcactagtaagatagtcacatatttacctaggtataactattgcaaaatcctcaaaggaggttgataccttcctttttgcttcatgtttttgagaacagtaatttgtttgactatacaaacaagaatgcagccatgaaaaacgaaagaccttatggcattaaaaaaaatacaaaagaaaacaaaaaacgaaaacaaaattagctacttaggaaaaaatagacaagtgttttctacctctctgtttccagcaagagaattttcaagtatgtacttttgctcatatggtccttttgttctctcgtgtttccaacattctggcagaaatcactgtaaaaatgttgggcagtgcagaattctatgaggctggaatagattttgaagtataagtcccaggtaacatgcctgcagtatgcaaagttcaaacaacctacctggttagaacaaaacaagggtttatgacactgttagaaaacatttccctgagagcgtcatgtgggagaataaaagcctcttatgcctgcataaatctgttttctgttgctataactgattaccatatgctgagtaattataaagaaaataaatttattcttacagaaaaaaaaaaaaaaaaactttcaagaaatattttggccgggcgcggtggctcacgcctgtaatcccagtactttgggaggccgaggcaggtggatcaagaggtcaggagatcgagaccatcctggctaacatggtgaaaccccgtctctggtaaaaatacaaaaaaatttagctgggcatggtggcgggctgtagtcccagctactcgggaggctgaggcaggagaacagcgtgaacccaggaggcggagcttgcagtgagccgagatcgcgtcactgcactccagacagagcaagactctgtctcaaaaaaaaaaaaaaaaaaaaaaaaagaaaagaaaaaagaaatattttacaatagttttgctttttctgctcgggtttcatgatgcagaatcatgctgtaaggatcagaatcagcaaaaaaaaaaaaaaaaagaaatattttacactatttttgctttttctgctcgggtttcaagatgcggaatcatgctgtaaggatcagaataaacttttaccaatatgattgtttctgtaatatttttgataatttccttaaagatataatacacattttaccataaactcatataaaaatagctgttatcatggattacaataataataaaaacgtcatgaagcgttttcatttttgtgtcttaaagttaaatgtacgtatacatatttaggtaaaccataattttttgtaaagacaaataactacccaagactaacactttaaaaattgtgaagaaattaagggcaaacaatttgtctttgatatcagaagtgagtactccaaaagacaaacattaaagaaaaccattcgcctgtagtcccagctatttgggaggctgaggcaggagaatggcgtgaactggtcaggcggagcttgcagtgagccgagatcgcgccactgcactccagcctgggccagagcgagactctgtctcaaaaaaaaaaaaaaagaaaagaaaagaagaccattgccacttttagagagttagaattaagtagtctatgtatatatttttccttcagtatcacaggtagagagtttaagcacaatctctacatgatttaaagttatctgagcctccttttacactagctgtaaaaaggtctgaacaaactgaatttgataaatatgaaatgacaaacattaattcaatgctgtcacatcaatgtatttaaatggggcagtggagagaaagaccaataattaggcagagaactcaaagatgtaaagcaaagtggaccacaggtcatggtactggagcaagagaggcactgtgcctgtagaaacaaacccagggtcaacaggaaagcaggcaaggtacctggtgtcccgtttgctattggtaattaacaagccaccccccagatgtggtgggaaaatagccattaagctcacagactgcgtgggtctgaaattcaagcagggtacagagcaaaagattcgtttgtagtccacagtcaggctttaagaatgtgtgactttcagtctcaaaaccatgtaaaccccacataaacgagaacaaattgcactgtagaagagcatgtgcactagaagattttgctatcacgagcattctaaaataaaagctatcatgattagggacatggacaaagaaactccttgattacctggctaggtgaagtaccattaccctggctgacagcaacatattttaatagactttactaaatcttttttactttgtatccaaggtgtatcatacaataccttacatatgtttggttaatatttattgcatattcaattatgggttaaattttttaaaatgatgataaaaataagcccaacactaaagctggactgactttttaaaaattgagatataattcgtaccataaaattcacctatgtaaaatgtacaaaggtttttaatatatctaccaatgtgtgcaaacatcatcactatctaattgcagaataaattcataccataaaattcacctatgtaaaatgtacaaaggtttttaatatatctacaaatgtgtgcaaacatcatcactgtctaattgcagaatatttttatcaccctccaaagtaacctcatacccattggcatctgctactcaattcactctccctccagtccctgaaaaacactaatctactttctgtctttatggatttgcccagttgagacttttgaatgaaatcacagagcatgtggcctctacatctgacctctttcatgcaacagaatgtttacaaggttcatccatgttgtagtatgtaacagtacctcattagtttttatggctgaataatgcagatatacctttttttgccatttaattgttaaaaatttattttttctcaactttgtaaggcttttatattgtcgctgtaaacagccttgtatacttttgtatggacatgttttaaatgttttcaatacctaagagtggaatcctgggttctatgataaatatgtttaacattttgagaaaatgccaaattgtttatcaaagtgtctgaaacatattacattgccaccagcactacataagggttccaatttttccacatactcactaaaacttgttattgtccttcctttggattatagtcatcctagtgggtgcagaatggttgtaattttgatttgagtatctctaattactaatgatgttgaatatcttttcgtcacaagttactggccatttgcgcttcttattaaagaaaagtctattcatgattttttgcccatttttaaatagggttctgttaattgggttttcactcagttccctttctgtgagttatttcactttcttgatgaagccctttgaagcaaaaatatttaatttaaatgtagtccaatttatccatttttttcttccggttttgatgtcacagttaagaaatcattgccaaatctaacgtcacagagatttatgtgtatatttcctaaaaatcttaatttttagctcttacagtgaggtctttgatctattttgagttagtttgtatgtcatgtgctatatagaggtccaattttcctcttttgcatgtggttatccaattgttgcgacaataggttgtctttcctcatttaattatcttggcaaccttgtcaaaattcaaccgatagtaatgtaagaatttatatcttcttaattctactcctttgatatatttgtctctctttatgccagtactatactgtcttaattactctagctgtacgctaagttatgaattggaaagtttgagtctttcaatttagttctttcttttagtttctgactattttttattccatttccatgtaaattttaggatctgctttattttctacaagaaaataaaatagccagtcgagatcttattagagattacgttgaatctgttgatttaagttgtattgccacctttacaatattacgtctcccaatccattaacatgggatacctctccatttatttagttctttaattgtttttgaaaagaattttacagtataaatgtgtaagatttgcacttcttttgataaatgtattcctaagtattttattctttttgatgtcatgaataaatttgtttagtcaaacaaatcattttttgatcatccattgctagtatatagaaacactatacactagtatgaataaacaaaaataaatttttattattcttgtattctgtaatcttgataaactgatatattagttctaagagtttttttctctctttttttggtggattcctttggatttcatattcaagattatatcatgtcttaaaagagatagtttctctttcttcctttctatgtgactaaatgctctggctagaaccacccacgttacgatgaatagcagtgacaagggtgtacgtgctcaccttgtttatattcttaaggggagactatcagtattttaccttttttttgtattatttgtaatgtcacctgcagtttttttgttttgtttttaaaatagatgccctttattaggtgagaaatttctcttttatttctactttgtcttgtttttttttttttttaaacatgaaagggtattgaattttgttagataggaggtttttttttaatcatgaaagtgtattgaactttgcatctaagtgacaattacgttttcttccttattctataaatattgtgtattatattgaatgattttcataggctgaatgaaccttgaagccctggaataactctcagttagttgtggtgtacaatgttttaaaatgctactgaatttgacttgctagtgttttgttgaaggcttttgagtctatattcataagagatattggtgtgtagttcttgctcatttgtctttttccttataatgtctttgagtggttttaaattttgccattattttgttgaaggcttttgagtttatatacataaaagatattggtctgcagtttttgctttgttttgttataaggataatattgaactcttaaaatgagttgagaaaatgtttccttctattctattttcgaaatagtttgtgaaggattggtgttaatttttgtgtaactgtttgctagatttcaccagagaagccatttaattctaggccttcttttatggaaaggttcttgataactagtacaatacattttctggtatgaatctaattagaatttatttcttcttgagtcagttccagccacttcttctaggcaatctaatttattggcacacagttgttcatattattctctgataatcctttttctctctttgattgctgattttagtaacttgagccatctctttttttttaagctcagtctagctaaatatttctaaattttattgatctattcaaaggaataacatttcatttatttttctctgtttatttcagttattttcactctaatctttattatttccttcttcttgctttttgtttaggttgttgttattttgtaatttcataagttagaaaactagcttattgatttgaaatcttttctattttttaatatagacatttacagctataaatttgttctgagtcctgctttagctgtattccatacgttttggtatgttgctttcattttctttcatttgtaaatatttctattttttcttgtgaattatttcttgacccattagaaatgttttctataatttccacgtatttctaaatttcccaatgtctttccattattaactttaacttcattccattatgttggaaaatatatattgtatgatttcagtccttgtaagtttattcagatttgttttatggcttagcatatggtctatcctggagaatgtttcatgtccacttgagaataatgtgtatttttctgttggcagagtgctccatagctgtgtgttaggggaagttggtttatagcattgttcaggcttcctatatccttgctgatcttctatctagttgttttattctttattgatactgggtaattgaagcctctacatattcttactgagtctttccttccttcctcttttctttccttctttccttaatcaatataaaacgtattttgcaggctggacgaggtggctcatgcctgtaatcccagcactttgggaggccaaggcaggaggatcacctgaggttgggaatttgagaccagcctgaccaacatggagaaaccctgtctctactaaaaatagaaaattagttgggcgtggtggtgcatgcctgtaatcccagctacttgggaggctgagtcagaaaaatcgcttgaaccctgggaggtggaggttgtggtgagccgagatcaccccactgcactccagcctgggcaacaagagcgaaactccatcttaaaaaaaaaaaaaaaaaaaaaaaaaagtattttgtctctagtaacaattttggcttcaaagtctattttgtcaaatattagtttgtgtgttatacctttattattttcaacctttttttggtctcgagtctaaagtatatctgctgtaggcaccacagagtttaatctttttaaaaatacattctgttaatctgtgcttttaattgaagtgttagataactttgcatttagtatgtttactgataggggaggaattaccttttctactttgttatttgtacagtgtatgtctcctttctttgtgtgtttattcctctgtttctcaattaccatctttttgtacgtgtgttaagcagatattttcttgtgtacaattttaatttccttgtcaattctcttatatatttttgagttattttcttactggttgccctatggattagaattaacagcttaatatataatcatctagttcagattaacaacaatttaaaaatctatggatcttcacttctatatacttttatttcttcctccatgttttcattgtaaaattgcatctttgtatattatttgtatatcaatacagttcagtaattttttctttatgtagctatctcaattacagagatgtaaacgaattacacacacacacatatatatatatttgagtttatcttacttggagtcaaattttttgaatgtgttggttaatgaatgtttttcttcaaatttagagagtttttgtacatcatttatcgaagtattcattgtgcctctttttgttttccttatttctgggactccaattaactgtatgttggtctacttgatcattttccacaggtatctgaagctctgtctatgcttccttcttttactgtttgtttgtttctcagacatttgctgttaattgtttttggcaactgccccaaggaaaaatctggttgctgtgagaaaagctttgagttaggtcaaataaagataagccctgtttctggatgatttggggaactgtcagacagttcagatgatcataatgcactgcaaagggggtgtctggatagttcccaatgtgtgtttgttccccctctggtagctactaggctgctggttttatgactacagtaattgcagggctgttgattttcaaggctaccacgtagctggggataggaagatggaaatagagcatgttaaaacaccacagtgtttgttgtttagccatttttcttgaataaacacttctcagtttattgaaagccttggttagccttcagagttgtgataaaattgattttgacaattttttcagtgttctgattgttttcatggaggaatcgatttttggaagtccttcctctgctgcccctgctaatgtcatggcactaatcaattttagcttttttttttcttttaatgatttagttggtgcacaaatcttgtgaagctttaggatcttcattaacaagagaagctcagtttctgattcaattttaaaatgctaaataatgcagttctggttgttgtgaagttatataaaacaacatttcaaacaaaatctccttttaattggaaaattttaaataaggacagttttagtaatagtaacaaacacaaaattaattctttttatgggcgttgtaagggctcaccattccttaaataaaaagttattgtaattgttcttttcatcattgaaaccagtaataacaatgcacatttacatttacataaacaaaaatattcaatttgtgttatttttttttagcaaacagaagcaatgtaaactttcattactggataaggatttttaacgttggtaataacaagcatattgtgagcattgttgcacttgaagtgtttttcacaaagatagtctggggactaaaaatggaaacattaaggcagtttaggtaatttaatttaaatgtatttatgatggtattatatcaaacagattgtttactcagcacagtggctaaagtcttttcttgcttcagatacaaagaatttactcatagttaagaactatagtccccgatttagacaaaaaattaatagggacaagaacactcagaaaagatcttaatagcctggatgtaatcagggaccaaaatttaatttggctggccacaatgcctaatttttcgataagttcctgctttctgatacatgttgttttgtcccagagtaaaaatgaaagaataagcttaagaaccctcaaaatttgtaactatcttgtgctagaaaaagaaaggggtgagaggttgtggaatgcaagtaagaaaagaccacataaaacttacactggccttaacacagaagatcagaatttggctcacagttcttccataattatctatgaaatcatgaaattagaggtttcaactctcaaaattggataacagtaataaaatggctattatgtaaatgagatgagagtatatgagaaggttgaaatatgcctttgtataagttgtcagacgttcttatgacttcccaaataatgctttctcaaggaagcttcaaacaactgtgtttgactttgcttttccacttttctcaaccctctgttgatcatatattacagtctgcacacacaggaaactcccatcacaatgacaatttggcacattaaaatacatgtcttcatatgtctttgtgcttggtatttatactgccacaggaagctcagttcagaaagtctcttctgtgcaggacggtgcctgtgtagaatattttggatgctcatagggtaattggactctttctgagagaactcaggtaaatggtttttcactataaagaaaatattctctttcagtgtcatcaggggcctgtgtgtggcttggtgggaagaaagagggtgttaggaaagatcgcaataacttaacttgcaacctgctgttatgcacctgacagctgaatagatgctttttctctgtgggagcctgttaacctgttaccagcaagtctgattcttgctgaacttggtacaatattaatgaaaagccgcaggaagcagaggagaggtgtgtcccaggccatgctaggtggccgcgactccagttaatcacctcccagttcttgttagaagtttccttttcctgcctctttgaattaaaaaatatcgggtttattcaggatgtaactacagagaaacattttgagtttggaatcagaaggctggaccaaaaaagaagcaatcttgttcaacttcaaaagattaatgggtagaaaatttgaacaataatcttaaatgattgagagaaagttctgaaggcagggtatttgataaaaatatatttatttcatttaaagcattttctgaagaagaaaattaagttttaagttaaaattattataagatttaaatttatttaaaattgtactagagaactaagtaatataaagcattaagcttactgtttctctttagtgaaggtctcataaaactcatataaatctttgtaaaaatttttactgttaaaatttataaactattaccattaaattagattttttctcctctttttcaggcttgtttttctgatttcttcatctctcttgtgtctctgctgccattcctccctctcatgctggtccctggagacgcgatagtgaacaacaaaatgttgaccctgcttcctgctctcggggagcttattctatagctatagattatatattattctatagtagagggcacaagcatgaatcaactgtaagagaaaatgtaaaactggaacattggctatccttgcagccatggataaacatgaagtaaatttttctcctgatggtgatattttatatatatatgcgtatatatatatatgtgtgtgtgtgtgtgtatatgtatatatgtatatgtgtgtgtgtatatatatatatatagtgtggtacagatagtgatatatatatctatcacactatatatcacactatgtatatcacactatatacatatacatatactatatacatatatacatatatatgtcacactatgtatatcacactatatatatatagtgtgataatatatatagtgtgatatacctagtgtgatatatatatcaacacgtatgcctgagagcaccgttgttggatatgaaggtctggctatgatcccagttttcttattaattgacagggttgagtcagaacagtcagcagatcatgccaatcgctttgtgtcaacaccctgttgaggaagctgtagctatctttggtagcaatggtcaatgttccagttttctggaacaattttctcacacaatgaattcatgcttgtgccctctactatagaataagctccctgagagtaggaagcagggtccacatatatggtgatgatatatatcatcaccacatatgctgatttaagcatatatgtgcttaaatatatatatactgcatatatatatatatatatatatatatatatatatgcttaaatcaacatgtccctttcatgtctgcaaaatgatagcttatgaaaatatattcactgttatggtgtaaaactgtccctaatgccatttcccctttatttatttgggtttgtacattttgaagtactggtagaaaaaaagaattgtacaattttcttaaagtttatattatgggaataataatggaagttccaacttttcttattgctagaagacagccatagtttttacttttcaacaccaattcctcaggtaggtgactgtacataatttataaaaatgtcttcaataaatgactactattggaacaatcactggaacatggtgatctatttgctgttccaagaatacaagagaatcaaatgttagattttttttctttcatggtttacctgaattccatgctataagtttggtaaacttcttttttattacacagatgtacttagctaatgtggtcattgataagagtgtttttttaaagaagcagagatgaaaaaaatcaatgtaaaagtgttcatattgggaaatgagctgcagtaagaaatgattacaggctttatttaagctgtgaatcaaagcaaacatatattctctttgcctggaagactgatgaaagttggcagcaagaaaattaaaatttttctgtatattcactatataattgaagttcagtttctgcagattctgtctgttctctcattgattactcaagcacttctaaaaaaattcctgccatcttactcataatgcaccttcataacaggcacggtgttcaattctctttgtgcgatatagttagcaacagtgcagtagtataaggtgagtattacaccttgaaaagcaacttttttttttttttgagacagagtctcgctctgtagcccaagctggattgcagtggcgtgatctcgctcactgctgcttctgcctcctgtgtcccagttcaaggaattctcctgcctcagcctcccgagtagctgggattacaggcatgcaccaccacatccagctaatttttgtatttttagtagagatgggggtttcaccatgttggcctggctggtcttgaactcctgacctcatgatccacctgcctcagcctcccaaagtgctgggattacaggcatgagccactgtgcctggcctgcaacttgtttattaaaggctgtcatataaaaagcatatatttcaagaaattttcttgatattgagaaccatatatggcacctaaagactatgcatttatatgattaaactgtttacgtggctaaaacaaaacatatcatctaaaagacaattttcaaatcttttggtgggattgttatttggtgatgctttataaaattttatttaaaatttttgcttttcaacttgttttaatattctcttgtctgtaagaagagaataaatattttcagatacttttatattttagtcattctcattgcaagttgcacagagaacatcatcaacttccatgtgacatatctggtggataagttctttcagattaatccatgcaatttagttctgcatttatgtgaatagtttttagtcattttgaattcacagaacctttgaaattttccacctttttgctatgactattatctggtcgtgggtcatccaattttacttaatagtcatttatcttgcttctctattgtagtgtttcctcttctgtattataggcgaagagattgaaatattatgatttttttctattttatttttattttttgcattgtaggttatgggaagaatgtcttgaatctttaaatgatatgtgtaaaagtcattgtacattaattcagacaatttagctatgctccttttatatacgtattttaaacttcctggggtcacagacgtgttttgaaaagtaatgaaactatcaaatgcatatacaattttgcatttactattagagggatcattggcacccttaagacattctaaagacttgtggatatgcatacccacacgggtagagactgctgggccatttaagaagatattcaagatatacaactacattaaacacaacagaggcttactagcaggaatattttttccaaggaaaaatagggtgttttggagaggatggcatggaggatggtaatttggggataggttattgaagagtttaggaagaggattataggtggtttagttaggagacctaaagaacacacagaaaagtatttcatcttacaccaagcttatgttttacagagaagtatctactgtggcaagactaacactactcatttttgagttaccataagacagatttccgaattccatttaggatgaagttcaaaagttctaagatttaatagctgaaatgccatactggtttttagaaatatttgaattttatattgaaagtatgtttgttaaaaatgaaaacaatgaaagaatttacgagtttacataaaagccatttcctaaaaatttttctagatttccttatctattggcaatgggaattagtgattgtacttttgtcatttccaaggcacatgtcttagaacccaaagcagcttattaaatggcagtctctggaccaatataaactaggtgttaattttaaatcccaaaactaggaagataagtattgtttaaatgtttaatggttccattactagaaaaagtctttcaagatttgaaaactaattgtagtctctatttcaaggttatagaaaactgactgggatagggactcatttagttattccatgtgcttttggacatttttgtttggcaaatctgtagttagatatcattatttccctttaaaactcctttaccaatttggctgcttagatgccctactagaagagacagaagacagcccttaagtctggtaaatattattaaaatctataaaacaaggcagagagaaaataatatatttttacctgttttatactctaaattcattttaaactttttagttgacattttcaaacaaaaatgtgatgagaataatataacaaacccctatatatatcacggagctttaataatttttaatactttgccatatttagcatatttattatttgttgaaacatttttaatgtttttgagtgttagaaccattcttaattgcttgaacatatacagatgattgaataaaacaaaatatattgttcagtgggttagcgcacgcaaagacctgtgtaatgtctaccgaggttgggatctagaacatggtcaaaacccaaagatcatgctgcttcctcaccactacaccctacctcccaaaattaaacaaacagtatcctgagttccatgggaattactttgctttggcttgcagttttacttaagagaacatgcatttttaaatactacagttttatttcataaattttagtggaatcatagactaggtattcgtttgtatctggcatatttcgaatattcgtttcaaatattcctaaatgttattgtgtgtaacactttttcattaactttcagggtcgtatagtatagatgtaccataatttgtctatttcactgatgatcaacatttggaatgagttctcactttgcaatattataatgctgtataaaattcttgtgtataccctgtttacacacatgtgcatccatttctcatgtctgcagagaaaaattataggatcattagatatacagatccatgtttagaaggcaatgactattaggtctacttaagtcaaatttttaaatcgtgttatttacagatctgtattcttatgattttttttctttttgttactgagagaaatgagaaaattctcccaccatgacttcagacctatctatttctcatctaatttttcccaatttctggctgttccgatttcttgccctcttcctaatttttcttgtgagttttgattaaagatctctgaagaagaacatgtctgtggatgtaaacttcccatgggtttacagtctcaggctttcccggcctttaacagcatattcaaaaatttaactatttttacctgtttaccaggcacctctgctttcctcccaagctctgccacagttggacaaataattatctcctgtctttctttggaggtgctctttcctaaactcatgtctactttttcttttctatttttttttcttttatttttagagatgggatctctcttctgtcactcaggctggagcatagtggtgtaatcaatgatagttcactgcagccttgaactcctgggctcaagggatcctcctatctcagcttcctgagtagtcgggactaaaggtatgcacacccatgttccgtgttctgctaattgttttttttgtttttttgttttttttttttgagagccagggtctcactttatagccctggctggtctcaaactcctgccttcaggaaattctcccacctcggcctcccagagtgttagtattataggcgtgagccaccttatttttttcctgaaaaaaatatgatgtacacgttttgatatatgtatacattggggaatggataaatcaagttaaataatattgctggccctcattctttttctttaaattcccaaaagtttctctttcccatacacatgcttttggtgtttttgttttcaatgttttctgaattaatttatataatccttttctgtcttctattttgtctattaagatttttattagtatttacctcttcttttttattttagtatgcattttccaattcttaatataattcataaattcttctttgtactttttccttttataataaaaatattcaagagtaaatgcttcttttaaggtaaagatttcaccgatgcattggtttttatataaaggctactttagatgtgaaaatttaagttccatttaggttaaatatgtaggacatcgtttattcatatgtatttaaataatatcagagattgtatacagatgcataattagcttttattttgttttatggatgtgtaaatatattctcaatttgaagaattaatctattaaaataattcactggttatagtccttaaattcttcattatcttacttatttaactcttgatcatataattttgaaaaatacctattgagatttcccagtataattttgtcaatgtatattcacactttgaatagtttttttatagagttattgttatttgacacataaagggttttgacttaatctctttcctaaattgtgaattttaacactatatactacccttcttagcactctaaataatgaaaacgttaaggttaaaaaatttcccttggctataactttcatggtgacccatttgcattgatccagaggttaattttagagtgttattttgcttaatggttttaatattaaatcccactgtgactgataatatttccaatcttgatttgttttcttcttgaactgaagaacataacttagaattttcatgctttattttagtgttctttctttcttgtaatagggcttctttctggtaatagaataaccgtttccatttagcataacagtactagacattttcatcatatttttgtttactgtttattgtagttttttcttttaattttccatgacttccttgtttttcaggtatagagttgtccttttttaatttgaaatttctcaagaattctttcattatattagaggtaacttctttttcatagtacttacaaatgaacatatatttctctattatcatataaaattctctaacccccactttttctctttctatccctcttaataagataggacgtgccagatgcttctattcccctgctccctgtctcctccagtgagacttttaagacacttttgctatgacttctataatctcaaagccacttaagctcctacatcttagatggcttttacttttacttcatgcaattattacatttttaacctagagtatatttcttcataaatctctatgtaatatttaagctatacatcgtcatttattctatatatccataaacaactcaaagtttaataatttaccactcttcactatcttctcattttcccgtataggttgggatttactgctttgtttataattattcctggaatatttttcttacatttggcatatgagtgatatatttcaaatccttgtatttccaaaagcatcttttttcctccctgataacaatgatatttgacttgaagctctacttgcaacctagagtccttacctcttcttagtctgtagacattatattgttctaacattttctttttactcggtgtgaataagccatggttagtttgatttgtaggcctttttagtagcttagtcttttttctttttttttttttcaaattttccaatacttctttgtaaaattaagttcataaatactattaagaattagaaataaaagagggatagagaaagtgtgtgtgtgtattgagcttgaaattccttctgaggcctctttgtgttgttattgcagtggtgttcaaatagtgtctattcttactatttttcattagattctgtcagctctgtgtatttcacttgcttttcctgtccaggttatgtgcatttaggtctgtcagtcttcttgaactcctcacttttctctagttctgctactgggatttattgagtggctgaaatcctgtgaggggcagggggcacagtagtttctgttctttttgatcagtgatcctctagctatcagtttaccgttctccatttaggcactgggttgaagttccctgctctttatctgtgtgctttggtgcttctctcacctagaggaaccagcgagtcctccagggaacacctgcctttttctttaagaaagaaaaagggaggttaggggcacagcagagttctctgcacattcttccattttatttatattatggttcaatttgaaaaagatgtgatttatacacaactttttaggcatctattgagtaaaatgaaatatatctgtaatcttcttagtacattatatttatcaatatatcatacttttattacttggtggaaacactattaagtaagaagttcattctcatttcatgttcttaaatatttacaagatgcactgcttcctatgccaatctatgattaaatgtaaaagggaattcctagcacaagtaatttaataaaatttatacctatggacaaaggaaattgaaaaatatcaaacggattactaaaagtctcatttcttaggctagaattggagaattaaaataagacctaagctttagtctttctatgttgtaaagacttgtattatgtaaagtattcttgctttttaactatacagtgaaaaatgtagttactacataatgccaccaaatacattgctggacaaacacttgaaaagatctaatttaatggcaatattttttgtagattgcatttaacaatcttattttatgtctatgtttggttggaataattcttaggtttcctttctcagtttttttaagcataaggtcctatttgcaaataaaagacattatataaatgtcagattaacattcattcaaaatataacattttgaaaaacattgttagtggagctatggaaactactattggtaatctttggtggaaaatcatattttgaataagaattacttgaactaataatctattaaatagaatcattctcatgagggattttataggtacttttgcagtttcttaagtaaattccaaagtactatttcttgctttaaaaaaaacaacaacaaacaggctttctttgttaggtatctttatagttgatggcctgtcaggttcaggcattaaaaccattttttaaaaaattattttcatgagttatgttgactatttctcagctaagctccatttcaccaaagattgaccaattttgcacatggcataattttccaaattgcttcctatacatatttaatggatgacatatctaacagaaacaaacctctctaggaatctagtaatgggatagtgttgttagatacaaaggaaaatctcattttgaaaagttagaccttttatttgtttaccaaacactctgtattgtagtgtcttagcaatattaacacatttaatacccataactatactttgaggttattattccaatttactgaagaggaaatttagacacagctaggttaacacatttatcagaaaagtcatacaggtggcggatggcaccaaagatcccatcctgagcttcttcctctaaggccctattttgagcctccagcaaagctgacttccttgtgatggctgcctccaatttactgattgtgggagctaatgcaaactgcttaacctctccatgctatggttactctccccagaaagtagagatgataatacttactctgttttttttttcataagattaaaagaaatgatagatgtaaatcatttagcagggtacctgacttctattattatctaatagttcattttgttaaattacaagttaaaaagaagtaaaatctttgaaaacgctgagttaggtttaatcacagtagaagttttactgatgtgagcaagtattttggaaaaatagacacagagtacatcctatgacatttcattttccattccatctttaatattagctttcccccaaaaggcaagaataagtcctggaaattatactagaccactgtacatcttaatgttcttcatgaaatccattgttggatttttcttttttaaatagagaggttgatattgatttcaatatttgtaggagaaatatatttaaaagcttttcggctatttgtaacaaacatgatttcctacttgtgtcactgtacaatattggatgggaggctatttaattgtatataatccattaacccctttgattctttttgtagtaactaaagctagtagtaaaaaaaaaatgtaaaatctgctttgatctgcagttattaactagaggatactccaaatttggatttaaagccatatattgtgtaaagctactactcaatgaaaaatcctcaattatcttaagagcttgtctttaccatgcttttacatttacagtgctttccccttctccctttacaaaatttctgcttccatagtgccgggatgatttaagcaattatttatgatggcattacctcatactcattttcttctcagcaaagttgcatctatgtcaagactaagtagtgagagccaattgaacttactcccccttctttgctataatcaataaaatgcattcccttgagatcacacttatttttctccttggattagctgcagtattcttttaccctgcaaataggagaaaaaaaaaaatcaaaagccccaacgacattccaagattctgttcttgtcttactaaatttcctattgttggattatggtaagattatagactaagtgcaattaaagacacaagcatgtttagaaaaatggttggtcagttgattttgacaatgggatattcaaaactcagtatgaatcctgcctatatgaaaacacaatatgtgaatgatctggaaagcatttccattttgacgttaagacctttattatttacttttcagctacttttgtgagaagttaccaatcacttcgttctgtgatgtatttagtcagaggccaccagattaattttcttggtgacatgagtactatggaagcaaaagctaaaacccaaatcaatgcttctatatgttttaaaattctctggcttttggataataaaagtctgctaatataggcaaaggatctttttccattgtaaagtttgtagaaattgaaaatgatgcaagcaatttaataacatactttagagatgttttttaatactccatttaaaacattttaatagaatcttgcagttgagaattaagattcaagtattaacgtttataacagggaatgatagacatgttaattctgcccattatggcgtttagtaaaattgttactacgtgacaaattcgtattttctaaaaagaaagctaactttaaaaaatttctggttcaggttgtctagctcatattctttttttctaatataaaattatagacttggaggaggggtcagaaaacactgaagggagaaataaaaccaagaatctaaaagttttatgggagttctctgggtatataatattattaaggcaagcgtaactaccagttgacctgaatacctctaatatgtccatcccccgagactgcagagtcacgttctcaaaaggaaaaccgattagatgtcaaagctctctgaagcacctgaagaaaccttgaaaaagactataaattaagtttagggaggctataaagatagtggaaatggatagccaaaagttgcagttggattagaggctgtaaagttgaatagctacctgatgtgctccactttataatatatgatgcttagaaacctttgatattaaaatgaagttggatcattataaaaataattaacttggtaactcagaagggcaaatatttactcaaagcatttctatatggagggcaaagtgaaaatagagtttgagatctgaacacattctaaatagttacttttctccctgtctacaagtcggtaatttctaaagatcaccttagtataacctacagatacagatgtagagatactattgagtctctctaataaagactgttggacctatatgaataaaattcattaaaaaataaaatgtagaattttgtagattgctctttaatccatcaaatttactgaataactgtttaactctgcacttcattacgcctgtctgggtacaaagatgtacagctttatggatactccacaactctaaaaaaaatgtagaattttttaggttgctttttttagttcatcaaatttactggataatggtttaactctgcacttcatttatgcctgtctgggtagagaagtacagctttatccatactccaaaactcagattgggtacttgtctacatagaatatctgatagttatacctgggtcaatttattttaccctgacacattattagggacattgaatgcccccacctttccagattgttgaccaagcgattaatcattgcttgattaatttttattagcaatataaatgagtaaacgaatcaagtaaacaatggttctattttgccttccacatgattaatcaatttataagattatttttacttttgaaaatttctttttatttgctctcataatttctagaagaaagcaaattatgagtgtttaccttttccaaaagtctaccaaaagggctttggtaataagatgatatttattcctggtagacatcaagcatgtaatcattattttaagaagagcattgagaatcctttgcctagaagacctgttgcatctatatttatttccttcttttctttctccctctcttcaaccctgctcttttccttccctctcccttcctttcattactacttgcctttcttttccttcccttcttttcccttcctttttttttttttacattgcattcctctcctcacttttcatacggttgtactaatactctccttacagtctgggcctcacaggtagaaaatcaaatggatttgaagaaacaaatagatctgagcccatgttcctgaggcactacgctctatcaaaaataaacaaataataggatcaggcattcaaactggtgttcccatcacactttgtatatttatattgcaagtctaacccttttcattctaaaaatatactatcaatatttgcctatctttcctattagaaggtagtatctagagttttttcacttacattagtatgtttattacttagcatgatacctacttgaccaagcagattaatcactgcttaattttatcagcaatatggatgaataaaagaatcaataaataaccattttgccttcagacaaaggagtcaatgagtacattcagaaaggaccagccatagaattcgtaattgctctttccaggactcatggttagataaacataaatatagggccctgcaagcttgctgaaataaaaaaagtacattgagaagatttgctccaggaaaccactttgtctaattgatgtattggtttccttagggtcagcataaaattagtcctttaatttgttatggactgtgatgatcagaaatgttcactctttgtgggtctgtcttctgatgtaattgctacagtcttgagttccttaaaaaaaaaaaaatcgatgatccttaaataaatcttgagcaatgttcaggtgattatttctgctcccaccatctctcttgcctttcctaataccttttccctaaataaagcctttctctaacacaacttttatccaactggcttttaagcaattgaattttagctctagtgtcagggcatgttcagctgcaactttgatgcaatagtctcctcagtgactagtaatgaaactgtatagtagcatcagtgaacactgaataaaaattttatcagttttctctcagtttacattgatgggggagcaaagataaaatggtgacgtcactaatgtgagaattgcgatgtgttaaaattaattcacaaaaatttatatgtttgttttcaaatgatataaatatattcagtcttccttagctatttctcttgtcttcttttccacctgatatttttctgatacatatttattacttttcaataaaaagtgctgtaaatcttcaagataaaagtattattatacacatcttccttctgttcttatgtgagaatttatcgaaaacaatgagcattaattggtgtggctgattaatcttttatatccctgcctactacagttatgtaatttcataataataaaaacctggaaatatatatttttttgctttcatgaggcgttattcaccaattgccctggcttacgcgtgccctcccctccaccccccaacacctgccactcacacacacggatttactctgtagatctatggactgcattctgctatccttgagtctctaaatctttatgaattctggctagagattgtttcaacataggaattcacatgttttttgctcatatcatttttcttttcatttttgcataaattgttagaaatgtattggttaaaaattttaagtgcccttaatttttttaaaaaagctagtattttttctgatgaaaaataaatttataccttcttccttgaaatatgacatacaaaatttaaaaaatgctagaacataattaacatgggcctagctgaggaccaaaccatgaagtaaaagtgaaagaattagctcatagtcctacaaaattcagaattgaattagttaaaatataaatctagtaaatctaatctatagattttaacgcatcctacatatttgtatttaatgtatatattattaaggaaattgtttttaccagcattgcacgtgtaccatttcacatgctatatttcacaagaaatattgctcagcctccccactttgtgtgttaatattctctaaagagcccagttgcactatccaactgaaaaatcactttaatcagtctgtttagtagtgaggacgaggataatttaactctagaggattctttccacttgactaatagatagagcctcagatctcaacccgcactttgaaaaagcattcttaggaacccacgccaactggacgactgatggggtacttcactattttgtggcaggaaaataggagtatgaacatcccccaaccataatgtgtctactaaatgaaaatacatgttttattagaatgaaaacccacagagagagattatacgagggcagcagttttccctttctgttgtgcacacaaagtaaactggagcatgcttaagcgtggactctaaaaccagatactctaggcttgctttcttcaaggtatttttccctcatctttacattatctttacaaaaaattaaggccaattacagagattaaaagagtgagagtggagaaagtacacaaatgcaaatatttatactttaaggattcatgatattaataaaattttagcctatgttttcaaatatcaatgccagcccattcaatacttcttctgagtttaattttttgatgtagcacttactgctgtgcaattttaatatattaacccattctcctgtttattatctgcctttccccactggaatgttggcccacatggacaggaagttggtctgttttgttcattgctctatgcacagtaactaaaagagcacctgtactttatgggaactcaataaacatttgctgaattcagccaggaagtcagcctcagaatggtcattggaaaaagaggagtttcagtatgggagctcaggaggacagtttacaaagaaagatctccattctcctcctcacagatcttcacgatctgtcataaatattctacgtgcccagatctttataagtatctgtaatgaatgatgtttacagtaagatagatatttttcaaagacaaaaatccaattttattagaaacttcatgcctcgggcctacatgttgtgtagtttgtcatgaactctgtaactgctcatctttgcttctcatagcgtacacatgtacattcattgtgcatattgttttacggagaattcatgcttggaaacatttccatgaattttggagacactgtaagaaatcaagttctttatgctgcatggtctccttttacaccaaacaaattataaggtaatgttaacttagtatatttaggaagaaagaataatgctgaaatttgctgttgtacttctaagatgttcaatttcaggatagagcagcatgaatttattgagtatcaattaatgatataaggcaatttaagagcattatcttaatgcttaatcttagaatgtttgttttaatattatatgctgaggatgaagcaatattgaagtgctataagcttcatttgtatttagcataaaagattttaaactaattaacctaaaggtgtccaataggtttttcttctctgtctttgtgtagtttaacatatattgatgttaaaacataattatatttacttttgcctagagaagtaacaccacttggggaaaatatttctgagagataagaaatacccttttataatattttcatatgctcaccaaatcattctattagtttggcaaaatccacagacatttatttcccactggcactggctacactgaacgtttaccaaagtcatttcatttttaatgagattcttttggccttgctgtttaagcgccagaaagtgccagagggtaaagctatacagtaggttgaatagtgtctgactctgtccaaagacccagttaggagagtttagtcagggagaaattttgtcctagattagttgttaatgtccatgtaaaaccatagagtaattgcgcattttaaaatttactttgctataaggcacttggtttaaaatgtttttgggagttctgcctttatatttctaacaacgaagtaacaaaaaaaaatccagatatcatctggtctaaacctatatttaggttgaatgtgaaataatctaagacagatggtgatctgtgttattttggtagagtttacttctttggctttaattttcactggcaggtggattcaaaattcaatcacaataaagttattaattttagatgtattttaaatagaatgactcccactattttctcctagcattataatttatgttttatattcattatcatggtttatacatttgggcaaatctcaattttctgaatcttggttccatcttttagaaaaagatggaggtttgttggggaagcttaatggtcaaagttgtggatataataataaaccagatataggcttaattatgcctatctttatttacagaaattgaaacaattttgaaccaacactcaaaaatcatgagattttagttcaaaatctgaattcccaggttcgtctggaaaattggaaaagctacagattagaaggcaacattctcacacagtaataatcatctagagccgatcactggctgcttgctagttggtcagtttctatgacttcctcttgcctcttctctctgacactgaaactaaagaaaatttctaaaggctactttaaagttcatatggaaccaaaaaagagcctgcattgccaagtcaatcctaagccaaaagaacaaagctggaggcatcatgctacctgacttcaaactatgctacaaggctacagtaaccaaaacagaatggtactggtagcaaaacagagatacagaccaatggaacagaacagagccctcagaaataatgccacatatctacaactatctgatctttgacaaacctgactaaaacaagaaatggggaaatgattccctatttaataaatggtgctgggaaaactggctagccatatgtagaaagctgacactggatcccttccttacaccttatacaaaaattaattcaagatggattaaagacttaaatgttagacctaaaaccataaaaaccctagaagaaatcctaggcattaccattcaggacatacgcatgggcaaggacttcatgtctaaaacaccaaaagcaatgacaacaaaagccaaagttgacaaatgggatctaattaaactgaagagcttctgcacagcaaaagaaactaccatcagagtgaacaggcaacctacagaatgggagaaaatttttgcaatctactcatctgacaaagagctaatatccagaatctacaatgaactcaaacaaatttacaagaaaaaaccaaccccatcaacaagtgggtgaaggatatgaacagacacttctcaaaagaagacatttatgcagccaacagacacatgaaaaaatgctcatcatcactggccatcagagaaatgcaaatcaaaaccacaatgagataccatctcacaccagttagaatggtgatcattaaaaagtcaggaaacaacaggtgctggagaggatgtggagaaataggaacacttttacactgttggtgggactgtaaactagttcaaccattgtggaagtcagtgtggcgattcctcagggatgtagaactagaaacaccatttgacccagccatcccattactgggtatatacccaaaggattataaatcatgctgctataaagacacacacacacgtatgtttattgaggcactattcacaatagcaaagacttggaaccaacccaaatgtccaacgatagactggattaagaaaatgtggcacatatacaccatggaatactatgcagccataaaaaatgatgagttcatgtcctttgtagggacatggatgaagctggaaaccatcatgctcagcaaactatcacaaggacaaaaaaccaaacaccgcatgttctcactcataggtgggaattgaacaatgagatcacatggacacaggaaggggaacatcacacatggggtccgtcgtggggtggggtggggggcaggagggatagcattaggagatatacctaatgttaaatgacgagttaatgggtgcagcacaccaacatggcacatgtatatatatgtaacaaacctgcacattgtgcacatgtaccctaaaacttaaagtataataaaaaaagatcattttttcaacaaatggtgctggagcaactgaacatccacaagcaaagaataaaaaggttctaaacacagaccttacactttcacaaacatcaactcaaaatggatcacaaacatatacgcaaaatgcaaaactacaaaactagaagacaacataggagaaactgaaggtaactttggtgatgacctttctttaaatcacattttatcacagtttatttgtagaagcaattagaaatcaaaatactgaaaaatgctttgctatacataaaaaattcctattttttttaattacaaggtgatgcctgtgcatggataaggcaatttttttcttacaatttctaaatatgaagataactggattaaaactattaaaaatggaatattggtttctttcaggcattattggttaaattagtgaaattcaaagtggaaaaatatgctagacatctattaaaatagtcatttcagctatggtagctaattactcttttagtaggcattttaagagtctttcataatgtatagaaattgaatggctattaaatcatttattcattttttttaaaagacaatttcttttgtcattgtgctttaaatttttttcaagtagatactatttttctgtgtgtctctaacaggaagcttataaaagttaaaccaagaaggataagcattcatggaaaattaaaagaccctattatttaatagaacttaataatattcttatctgtttaatatgcaaacatagtgtatctatgtaaaaagactgcaatttaaagccccaattcaaacaaaccatagtaacggagatgaactacattcaaaaagatatatcatgaaaaacttaatgaactcaaaggaaaaggctgacatttcaggagggtttattttgaaatgcaaataagcacaagcactgctgctctgaaaagcaattatatcacaaatgaataatgaattgtcatacatcaatacttttttaaatggtaatttttagagctgttcttattaaatgaagaaaaattgcacatagaaaagtaacacatggcaaatacaagggtaactgaaataactgttgcccagaaatttggaaacatggatgaatacaccaagttcatattaagttaaaaaaaaagaagtaactgatttttactgtttttattctctgctgatgtcttacacatttatgatacatcatcagtggaattatgatgtctcaagatacttgtgaacatgaggtgtatgactaagacaaattcataaaatgattttgtgtgtgcgtgcacatgagtgtgttgtataattgccggagtgtttaacataaaattgtcaagattaatgactaaaggcagtgttttgaagatgttcagttaattttggacttaatacgattcttaaatcctatttggaaatgtttagcaatgacagaatagctactctcattcagctcatcattcgccatgaattactttacttaagaagttaagctggaaatcatgctggtgtcaatgattaagccagacatttgtgtacattcccatagcatcaatgatcatcttctgaactctctggaagaaggatgatttgtcacttgatattgaacagattctttgaaatgtaaaatgtagtgtttatttcatctaagataaaaaaattaatcttagctcacaagcaaagacggaatcaatgatagtcttttcatcatctaaatgccttataggatgccatctcaatgccttaaaggatactttccagttacaagtagtaactggaaagtatgacttgcttacctgatttctcatgaaattatgcctttggtaagctccttggtcaaggattaacctggcaaatacttcttggcagaaatcaccctgtggagcttaataggattgcatgaatggcatgtctaatatcatagagttaagaaataaaatgttaagaaaagtctcaggattaaaactttctgacaatgacctcacattgttaaatcacataatatgactaggtaagtcaagagccagaatcagaagatactttacgctggcacagtccaattccaaaaattaaatgtaacttttacttaacttaaatgtaaatgtagctttgtgactatttttttccagttataaactgaataaaagtaagcaatgctgctagttaagagattgaaaacagaattctgtatactgtgaaagcacaccataatgcaatgcataagagctggcatcttggtgtaggacatgtcaggtttatttttccaaatcaaagaaattaacaatgttggaagatatttctattttcattttttgagttttcaatttcagcttttaaatatctccaataacatacttactcttgtggcaatatacttatatttcagtactaacagttcatacatctttctgagagttgacaatgtttacagctcatcaattgcattcatttatattacatgctttatccattaacgcaatacttgtctttagctctaaagatgtctgagtcagtatctcttaggctaatgacaagagaaaaatttggagaaaatctaactcatcctaaacataagatgtctatcctgtattttaaagtccccagaaatgggctttaatggtgctgtcagaaacttgttaattttgattttcaaatgtgtttatgtatgtgcattttcaatatgtacatatgtatgtatatcgtatatcttagcttgttgaacatctatatctttaatcatttatgctccattgaaatgatatagatatgatcctgtacgctatgctaaaaccatagtctaagagaaatgtatataaaaggcaagggccaactttccactaaaattgccatttactaggtcaggatatgtacacttatttggaagaagacacagccacatggaaagaaaggttatgaagttctatttcttataattatttaaacgagtctgagattataatatttctcatatgtagaaatgatttaatattcacttagacttctctcaatgtatggaacacatttgaatataacattcgtttaattaaactatttatttagagtttccttgaatgactttctctacaacctgacttcaacagataattgacaattctacacatccttttataaaactgactcctaaatacaattaattagtaagctttgaaaaactcccacatctcaaggatgttttataaaaagacaaagttaatgatttcaaatcttaatttatattaaatcaaactattcccaccatctgcagaaagaactatcttgctttaaaaattggagaaacagaaaatatagccactcaataaccactgcatcactaacctttatggtatatgacctatggtgccatttagggtcatgatcccttctttcattcttagataatatatccattgctcctatatgtagaaggaactatttagaggcaaatgctattcaagtactgttccacagaaatagaaaggtacaatgtcatggtgtttggaagtgaactgatgatgcattgcactagcatatagagacattgttcccataaaacttgtaacattatagttcagggactatttaacctttaatacaaatcatttttattgtcccaatagaactcgcaacactttattctttgcatttctcttcagcactgtgtaccaactacattattattttgtcagggtggaaagaaaagacatgttaagtctaatccatgtgcaaacacatctgaagaatatttaggaaggtacacatctccatcaaatatagaacatgaagactcaaaatttgtcactgatgacagaatatttctgaaataaaatgatcttccagactttcctttattttcagaattacgtacagttttccgctttcttttacatgctatcagtgatgtgctttcaaataattctaataaaacaattctgcaacattgaatagggaaaatgccagaataaagcttactgccgccagtgtgtttatttttcgtactgtctatttgctattatttatttctaagtttatctggcagaactcatcagaaaaaacataaagtcaatttatttctaaattttaaaaatctttttttgatagggacttaagttcatttacattagaatgtatcttctgaggaaattggttcttcatcttttgctagtttgttttgtcttgcaatcacgttccttactcttttcttttttacagtttgccaaagacaaaattttcaaggggcatagtatagggaaaaggggaaacaaaaagaaatacaatataactaaattaagtgctttaaattccagtgggaaaataaaaatgatttgtgttaaaggttaaatagtccctaaaccataatgttacaagtgttacaggaatgatgtttctatattcttgtgcaatgcaccatcaatctacagccaaataccactgacattgtattttctttttttatctctgcagaacatttggataccacttacctctgagacagttcttttggaaattataaatatatttctttccggggatcaaaagaatccacatcaacatgaaagatgaagtgttgaatctgaattcacagctgctttatgcaatctggaaaaagtacgggatttctcattttagttcagttctcaaagctttgtagatagaggcctgaaatgaaatatttgaatttttaaaaatattcttcttgtctggctgtgtaaatgattgcaatcaatcagattttctttgttcaagaaaaaaaacatgaaattacaatatgaatatttttcacatgtaattttagttatacagtgggcaatgactgacagcttaacaatgtcccactgtggcaagagtaatgtgttattttgggaaaaatatttttacttaagaaaagttaacttgcaataagttgattttaaaagtctccttggaaaataattttgaaggtcacaaaagtatatttggagtctattattttacaattttataaactaattttaaaaaatgtattaagaccttacctgttacaaaaacagaaatctgcagcaaaaataaaatgatctatttcatggttgtttataatatacaaacatttcagagaagtatcattgcctatttcaaaagtgttacattaattacaaaacaaattttaaatattggaaaaattatattacaaaaataaattccaatggcaggatagattattataatcaaatggatgcattttttgccattttgaaagaaaagctatgttcactggacgttttataattacactgtttcaacaaatcaaaactaaatattttgtgattttgcttgaagattccaaaatgagttcaattttaaactgtaaatatacaatatttaatataatttccccctttgagtgggagattttactgtaaaatttgttttatccataaaacaaatttagtataaatattgttgtaatcaaatattatacagagtttgagagtgatgtccacaaaatggtaaataaaatagaagatctcctgccatcactcctttcaaaagagtacaacaggaaactattcaaaccaaaattcaaggaagtagtggagaaatccctgggtccatgtggagtttagactttagactttatcttacatgcaatgggaagctatttacaggttttaagcaaatgattatgtctgtgttttaaaggtattatattctagatgcttcatggaattacgtcatttatactttataaatctataatgtgtaactgattaaaaacaagcttggaaacataaactcaagttagaaaatatgggtttgacataaaaccttaaatatgtttcatttgtttgcttgtttggcttgtttgtttctaacacaggtttaacctacatgtgagtcacctttggattgatgagtctagagtttgaaacagacaatctgggtacatatatttagagaaggtcagtccgcaaatgatgcttaatgatccctgggtgatgatcaccttaaggagaaagtgcatggaaagaaaggtccacacatactctgaaaaacttaaaaatggtcacataagaggagcaagactgagactcacattttctctaccttgaaagggacagaaatagccatatacataggaataaatcatgtttcttataattatttatggagtccaaggatagaaaggatttgccaggtaaccatttagtgtttgctgaatttataatgtgtgaaattgacagaagcctgagctgcaggggaaaacctggagagtgagaataagggtcttaagaagtagtggttgtcttggtcaatgttgaaaggtcaaaaaagtgagaactacaattggtcatttggatttggctacatagtcactagtgacttctgtaaagagcagtttcggtggagtgtggggataggagacctactgaaaatgcaccagagaatgaataggaggtaggggaagggaaatagcctgtgtgggaacaaacaaaacaaacaaaaatgtttttaacaaccgcccttgtttgatccttcatccttgcgaattaaaacccaaaggagaaggtcttacatgagatcactgcactcatacaaaatgtaaatcaaaggaaactatgaatgactcaaagccaggagttctagcaaacacattatttaggtggcaggatcgtgatgtaaaatggtcccaataggttggaaagatacaaatataggttagcgttttttcatgtcaattttccaaattcaccaatgacgctccctgctattattttgggtatatcaaggattctaaataaaaacattcaaaaatctatcttcacaatttttggtcttcttctgaactctgaaaatttatctttattccacttaacatcctttcatagcgtcaacagtagtaataatggttgccagttctagatttctaccatttaccaacaataatccaattggtttattaatttaatcctcatggcataaattgaggtttagatcatttgtgcagataataaattgcttaagcaatttatttaattgtttttacatagaattaaattagtttttacctagaatgtttcacttctaaaacccacaaattcttaaatttggatcaattctcaatactgcttcttcatatgccaggctgctgagtacaacagagaaaatcacacagctggctagatgaatatctaatttatcgtatatatttatactacaatgtattctcagaaatttcatctgggttctttctttttttggtcactttctcatttctgctctgccatgactcaaaaacttctctgttcaaatatcttacccaatatccattataatcttcattgtcaagaacctcatatcctattttacagagagatttgaggccagcagatttaaacttgctttaatacctatctttataaacaaatgtattttttttcctacattcatttttctcttcttcgttccaggctcaaagagaaaatggccccattcagagtttaaggttattctttctgtaatttccatctgaaatatacttctttagatctattcttcactgagaaactacaatttgtgcttcaaagccctgcttacattttccttttgtgaaacagtttctgacacaggaattttctgcacgctccccaaacacagtcagtaatttttctacaatgctaaggctatacctatacacacattcatcgtacttatcaatgcatggtttatgaggtgggtggcaaacatggttgaatattaggaaaaaaagtttcccaaccccctttgccacatactatgattctataggactgagccagagcttagaaattgatgattcataaatattgctatgtgatgataatgatcatcctgggttggaaaccactgaatcataggcctcaggtcagggaaacagctttaatttcagctccgaaacttaatagaagaatggttttccacaaacttctcaaatatctgactcccagcaataaatcttttctctgttttcaaactatgttgggatttctaccacgtcttcccatttctatcagtatccccagccatcatcatctctctcatctggcctaatgcaacctcctgactgatctctgattcacacttgcttcatctattatattttctccgtgtagaactgagagactcctttatggaaaagtaatataatgccacttctctccttaaaaatcttccagggacttcctttgacatgcagaatctaatccaaattcttcacaatagcctatatgaaagtataacttgctgttacaaatttcccttttccaattcctgttattcctttgatttctcctacttccttttcacttgtttatttcaactcagccatgctgggctccttaatgttccttagctacactagacatgctcaggcctcagagtccttggatttaatattgtttctgtgtagactgtttccctgcagatattcatatgactctcttcttccctttattcagatttcttatcaaaatcacctcctctgagaagtattcctggcaaaagagtatgcacacattgcattcactcttactcatcaccgcaaatcacttattaatttttaaaaaaaatttgtttttgtcaatttccctgacaagacaggaaaacacgacatgaattgaagaggccagagaattctgggcaagggatgcatgaatggttcttggtggtggatgaggaaacattggggaagagatagcaagtgattatattccatcctgaccaatagggtcactcacagtggtgctgagaccttagcagccaaaagctcagaaataggatctgatttcttagtgcctgtggaagacatcaaaccaggaaaagtgatgcaatcttctcagtaaggagactgcaatatttgttcttccctaattttatttgcaaaatgttcaatcacagttttacttctgtgagaacaactctttcttactgggactaacacaaacaaaacttttttcttttttctttttttttttttttttttttttagatggggtctcgctctttcacccatggcacaatcttagctcactgcaacctccacctcctgggttcaagcaattctcatacctcagcctcccgcgtagctgggattacaggtgcctgccaccacgcctggctaatttaaaacttttttctatatttaaatttttttctgtatagtctggtttctatttaacaagcactgtaattagatggggcaaaatttgtttagtgtgatctggtcatagttaactggtgatattatggtgaaaagctgtatcatatttttccaattccatttctagtctctaaaaccatttcttcctcacacactgtgttttgaagacagaagttaagtgtttttgagtctggttccaggaagcctaaaataacataccaattattttgattaaagaaaaaggttgtgggtcattttcctcattagactatgtcagttatggtattgctgaacatctattattttttctcccaaataaaaatgggctctatataattttattttagtgttgaatggaaaaagtgtggtccagaagccttgttattagttttcctttgtaaaatgtctctcagttaattagaatcgtatccatttataaatatttcattgcaaatttattaaataagctttaagccttgtcacagaggtggatggtgattgtctaatttaagcctgaatttttgtctgtaacactgcctttgtctggtgacaaaattttgtatgagcttagtgaaagtgggtttagcttattctattgtccttttgttgcattgccatgacaatgtttcatacagacctatattctcttttacttcactctttaccactttattatctgttctacctttaaatgacttctgcattaatttacacagtaatccattgtgcattggtgtatgccaccaaaaaactaaaagcatctaaaaatatgattactgtatattcattggtcattcatttgctttcaatgtagaagatttaggtgaggttcataagaactggaagatttatcagctgtttcaaaaaaagtctataataagtgtgccaagagacattacctcatagaaataaacccatgaatgtttgatgtcccctccagtttactcctgtactttaaaacacatcataatgcacgtttttcaagttttattaaagtgagcatttttctatctattcaaaatatcatattcagcatagtgattataggaaaatcctttggataaggcaaatgactctggattctttctagtcctggctacaactgaatttaataggaccttattaaagtcagtttaactcaaagggtctcagttaagtattctcgtcattttctttctttctttctttcttttttaatacagggtcaagctggagtgcagtggcccaatcctggctcactgcaacctctgcctcctgggctcaaggcatccttccacctcagcctcccaagtagctgggactacaggtataagctaccacatctggctaatttttgtctttttagtagagaaagggtttttccatattgcccacggcattcttgaactcctgagctcaagcaatccacccaccttgccttcccaaagtgctgggattacaggtgtgagccaccacgcctggccagtattcatttttttatgagggagtgaggggtcagttttctgacccatgaaagcagatattgagagtttaagcatttttaaatttaaaataaagttttatataagatcgctttttgttagtaacttaattgctccttggatgctgtagatcaaaattttaaagaccgttaagatacaactttatatacaccacgtgcctcattagatgatttggtcaatgagagcccacctatacaacaatgatcccataagattataatactatatgttttctgtaccttttctatgtttagatacataagtacttaccactgtgttacaattgcctacaggattcagtagagttcatgctgtataggcttgtagcctggaagcaataagctataccatatagcctaggtgtgtagtaggctataccatctaggtttgagtaagtacattctatgatgttcccacattgacaaactctcctaacaatgaatttttcagaatatatctccatcaaggagagacatgactgtactgccttttgtttgtaccactgtgttcttattcaaagaaaaatatgcacattacacacaactttaaacttattcacactcatattagcaatcaagaatgcaggaatgtacagtacatgcacgaactgtgccttgaccatttgctgacctgatacatgacttaatgtatttgatctcacttgaggaaatcgagtttggaaaagaaaatgtgcatttaacgtaagtaaaattatattgaatgtttcttcctagtttaaaataatttttcagtaaaacaggatctcttaaaattatttctcattaaacattgagctatttttcttttattagaaattacctatcaaaatagtggctgtctctcttaattaaaagtggattggtataatgatatactattggatctgtaccctttctattctgtttttttattctaatttatagagtaatcacaactatgatatcaggaataaaaatgtcctcaagaacaggtgcctaattgggagagaatttgacacttcccatttccattttaggagttaaaaaaatctacacgttaagttatttttatagttaagaagtttaagtttgtttaaaataccacaaagtataaaacgtgatctgaatattgttaaaaggtcatgcaaattagaaccatgcttattcaatttgaatcaaagtatatttaagccatttttcataaaattattgagattattaatatttaataacctaaatcatttttataaagtgataataaaacagattatcctaagagattgtttttgttatggctgcatcaaaagaagctaaagtgcattgtggcaggaaggactagtgtcatttatagtgacattcaagtaatctgggtgtgatagatgcttgactgctaaatttatgctaggattagcaccatttatctgctcttagtgtgttaaatactcaatgaaatatgtatttatgaaagtaattcagtgtttttcaaatttcatgacgcttttaataaagctgttaaattaacagctttatggggttataattgatatacaaagaactgcacatattcaatatgtacaatttgatgagtttgaacatacacaaacacccatcatatcatcaccgcaatcaaggtaatcaacatatccagcacattttaatagtaccataaagacttctccgccttttaagagtcctggtagtctcagtgaaacaaaatctcttgattttcaacattcctctaatttatcagttctttccaactgggatttaccaagcaatgtcattttgtgttgaattaccatgagtttttaaaagatgctaaaagaaataaagtatgttagaatttcattgccaatcaagattttgatatgcgatctgaatttttagaccagtggttctaaggttggtgagggagaggggaagttgtactgtgtgggagacagttggcaacgtctggcaatattttaattgtcacaattgcagactggtgccagaatctagtatgtaaaggccagggatactgctacatgccctacaaggcacagggcagtcttgtagtatctggcttacaatgtcagcagtgctgaggtacagaaacactgatttagattaatcattgtactcaaaagtatagagtgagcaaaatgtgttgtttgccttgtgaaatttggagaaaaaaaacaaagctctatccaaccattctacatttctgacatctgtgttacatatgattggaaattctctttcttctaaatacccattgtgtgcttcagtgactgctgggatacgagccacttgttcctacagtaattgtcacaggatagctgccagatggtaatactgagaagcacaacatgaaaaaaaagtgtgttttttttctcatttcattctatcttcataggctaaataagttagtctaatgtttgttctaccctactttaagcagaagacataattccttcttgcaaatggcgcctaaatggtgaacagacatgtcatgtgagattcttttaatagatctgcttattatttgcccttatggaccatttgacattattcaaagaggaaagattttttttttttttttttttttttgccactaaaagagaatctgggtaggcctatgactcttctgttcactcttggagagtgctgtgataactttaagtcatacatgctattagaatgccctgacttcataatatgtatagctatgcatttgatttaaatcttcaccgtgacatgtaagactggcttcaggaaggctgttgcctgcaaataggcgtgaccagcttgttctctcttttccatttgactttttgcaaagcctctcaaattgaaacagagagaggggcatggtcagggggtagacttttacttagaggtgctgctctagaatgggtctgcattcactatgtctggcaggttgttagcatggacttttccagttactagcctaatttaaggtttcgtggtatcactaaagcgcctctgcttggactccctgccatgacgtggctacaggcacccttcccctgagtactactccctgtatacctctggtttttcaggggtccctttcatggaaaaactcttttgagtctcactgtatacacacatgatactcttgagcaggaatcacattggctccaggccgacacttccctgcatgacaaattatctgaattataagaaacatttacctatcatttatcttgacagattctagcagtgaatttcctaccaaagaattatggcagaatttctttcttcttgatggctaaccttcaaactccatgaaacacagatcaaggtgacctttgtgagtcacctgtctctaggcttaagcaggtagcatctttccggtcatccacatttggagagaatattggaactcagcacagcagcaacactctccaaagtaatctctcaatctccattctctcaaactgatatgccgagctacattcaaaatctgtacctttgtaggctcagaatttactcggataactgacatttattgtcaattggggcctgagtctaaatatctaagatgccatttgtgattaccggaagcatccacatcgcaatttgctcatgaatcaaaatttcatagtatttggaaagatagaatgaaatcatattgatagcattgtcctcatgcctcattctaatggttaaaaactgtaaacaatatatgtgcataaaatactcattggaaattacaaatgcacatagatatctatatgtatatatgtatatgtttatacacgcatgtatatgtatatgtacacatattcatgtatatgaatatatgtacacatatacatgtatatgaatatatgtacacatatacatgcatgtatgcatatgtatatacatatgcatgcatgtatgcatatgtatatatatacacacatatgcatatgtgcataaaattctcctatatgcacatatacgtatatgtgtatatatatgcatatatatgcacatatacgtataggtgtatatatatgcacatatacgtataggtgtatatatatgcacatatacgtataggtgtatatatatgcacatatacgtataggtgtatatatatgcacatatatgtgcataaaagatatacatatgtatacatatatgtgtgtatatatatgtgtgtgtgcatatatatagtgtttttctttgttaaatggtttataatagtgcaattttcaattttggtgtgaagtattaagtaactgatgttaagacagaaatctaagaaagttattttaaacagtaatattttggcaatgcaaagctatctagtaatattgctcagacaatacaaagctagttctattcatatttgtcctgctgatctggaagataaaactgatccctccctgcaagggctgcactagctggaatgagacattgtgtttgtagaacctatgatcttctttacagagaaaagcaattcataaagttagaaaagggcatcatgtaaaatccaactcacattttgtagaaatagcatgaggattgctgagagtgctaagaaagaataaataatagcaacaaccaaaccaaaaacaacaagaaaaaaaatcctattctccatagtttattcttgagaatatgacatgcaaaaagtatgcctcagaaaatgtatcttaagggggaatgttatttgtgtattttttttcaaaagggccatgttcttaactgtttttgcactgcatttatatattgttaatgtccttttataacttgaatatatcttaattctacagcctattttgcattaagtgctctggatcaaggcatgccaatatgctatttttgatcttgtattttagttttgtctttttcttaattccaggtagcacacatgattattatgagaaaatgttttagatttacctgtatgttaaacaattttatttttgttgttaactcttctttcatctcagcttctttataagattattttcctttttcctgaagtatgcctttgtaggttccttcagtgaaattgtatttaccgtgttgatgagtcagtttttatttttctgaaagtgcatttatttctcctttagtcttgaatacttgctttgctggattaaaaagcttacttgatcctaatttgcaggcatcagggccttaatttgaagagactttcttgtggagaaaatgtgtctcctgcttcacttgaggaccatgaattcctaacaacgtggtaccactttgtcttcctttgagaggcctggttagtgtgagaacctcgtagtcagctctccaccaaggatataaacaatgttattagcggcatcttccatttcaggaagatattacaatggtttttacaaagagcatttcacacaggagtatgttcaaattttatttgatctgagatatgagggtatacctaagggtgttcatggtatactgtgaaaaaatttctaaattgtaagtaatttaaaaataataataatgttaacatactaaaaataaatttaataattgtagtaaagtttttaaagattgtcaaaacctttttcccctgccttctttgtacaaggcttaggtggtagacttgttaagtagggaaatgagatattcaagtttaatgcttaaggcacaatgggttaatgactataataacaggtaatactcttcaaactgttgtttgataatacatggaatgactaagttcatgttaataatgcacaatggtcttcagtgggggaagcaagggtaaaattgagatttaacatagaaactacagatttaatatgtagcatcactttaccactcaaaatttaattttcagatcacaaattttatatctattttgttctaattttaattactgcctccagatttcttatgtaaataaattcttatagatggttagattatgtacctctcattattattgtttgtcctaaaatggaatcagtttacagctagaaagacatcattaccaaactggatcttatagatggatccgccagatctcagtagttgttcagagctccagggtctgtcagtcaggatggggggcctagagagcactctgccatgtggatgtggcacattctgtaaccacatcttgctcagattacatgatacttaagactcatcaagccaaacttgagaggaggtggctcttttggcaagatttctagtgatcccagaatctttgtgaagagaaattcttatttgtttacaaagctattataatatgtataaaacactaagatttaattttatattaatatttgtaagtatatttttgttctggcatttgattaaaaaatataattccagaaagtacatttataaataatacataacaacagtcatataagctttttttttttttgagacggagtctcactctgttgcacaggctggagtgcagtggtgtgatcttggctcactgcaagttctgcctcctgggttcacaccattctcctgcctcagcctcccgagtagctgggactacaggcgcccgctaccacgcccggttaattttttttggatttttagtagagacgaggtttcaccgtgttagccatgatggtctcaatctcctgacctcatgatccgcccgcctcagcctcccaaagtgctgggattacaggcatgagcccccgtgcccggcctaaacatcttttaaaaatttaattctactccttatatggctgtcttggtcagaattgttaaaatataaatgtaataaaagccctagcaccatcttatatcttataaagaagaaaaattacttttagcttttatagtgaaacccaccaaaatgattgagtctgacagtatttttcaaaaacaatgttaacagtttgacagtatttttcataaacaatatggcccacaaaaagtgaactaacaaaatttcttaaaatattggtaacttcattgatacacaggaaggtaggtgggcattgggtctccaacttaagcatttatatgaagcattccaaaatagtttcttgttttgctttgagagatgtgcaagttcaccaacatagagaaagtcttcagttttgaatcattttagtgctttgtaatagtaaatgggcataaatcagggcacttgtataataatagcctacagtaaagaatagatgtttcagccgggcgtggtggctcacacctgtaatcccagcactttgggaggctgaggtgggtggatcacctaaggtcaggagttcaagactggcctggccaacatggtgaaacctcatctctactaaaaatacaaaaattagctgggcatggtggtgggcgcctgtacttccagctactcaggaggctgaggcaggagaattgcttgaacccgtgtggcggaggttgcagtgaaccgagatagcaccactgtactccagcctgggcaacaaagtgagactctgtctcaaaaaagaaaagaatagatgtttcaaagtgttttaaagaattatttactatccataatctggctttttacattcattttcttatttttaaatctagccctttgaaattcatcaactgtcatgtattattttcagatgaaaataatgagtgattattgaaaatggaatttaaagttctctgaatcagatgggaaacaaaaacttgccttcagtttttacagattccaccagactgtaaaatttgtgatgtcatagattttctctgttttgtttgctgctgtatctctagtacctacaagagtgacccacacagtgaattcatgcattactgcatgcatgaatgaataaatgtataaagaatctcacatgtggccattgctcacttattcagctcacaaccgtgatactctgtgtcacattattttatctcctctctcattctaacacctagcttttataatatgcttttcctagcattatagttacatttagacaggtgattttattttaaaaatgcaaaccattctttacaaatgccactcaaagccaataaagaattaatccctttaagatatatacttgcatatattgagactttcaagcagagtcagactttaaagccaccaaatgaaagagctctcatatgtgtcctattatcacagaggctgagtaccaggattttacttttaaaatttttatattctgtctctcccctgctcttctaaatagaagggaaaaagccagtatgttggctatacagtctttatgttgcattttctcagagaaatgttgaacagttatgaatagaaagagtaagaacccaaaagcatggcctgagtcatcccttgcttgtcattttgtggggaagttgagtctcatccttatcagttctgttgctagcctgggaagctgaaaccacagtcccttccaaatgataaccataattttctcccttctactttattttctcattttttcatcttataatgagcagttacaaaaacttttgggtccaaatgttttaccaagtcagttaacttacttcttaacctttttgaatagcccatttgaagccagttaacattgttgactctaaaaagactaaatataaagttttactaagataagtcatcatgttgaataaatacacaaatatgacctttggtatggatgtgcatataagcagtggggtaaaagcatccttgtatttaaaagtaaagaattctgtactacaagtagaaatctacatgcagaaacacacacacagtctggccgtagctacaggtagcatgcatgttccttttacatgtgagtcagaaaacctgattttattatgctctgtgttattcatcaaagtagtgagggcctttgggatagtgtgcattccttgcagagaaagcaaaacaagctgttgaattttcttttcttaggagagaagacaatgaggtcagctagaatgatggattgtcatcactggggcacgggaaaggggttgagcaagtcaatgtatgttttccagagcctacagaatgtgtctgattctctgaagtatattttttctaaatgccaggtgagtatgcaatgctaatgtgaggtagagattattgtcataagcattattacttaacatgtttttcctcttatatgctacacattacgatataagctttaaaatattatattggtttgattctcacaacaagcctgtgagtttggtattgctagcaatagttaacatatttggaaaagtcggaagagagagatataataactcgtacccatggaattaatcaaccattgatatatacaaggagactggttattttaaacaaagggaaagtgtgactaaataaaactttaaatgaaaaggagtgcaaaaatgctatcgggatcggagatacattttaaaaaatttgctatgtattacaattaaaaaatatattaatgaagtattttgaatagagtttcctaagtctaataaattttgccagggcatgagtgactaaaatacaaacaggctcctcaacatattctccttcactgtttcatcaatgccatacgtacttattaatggttaagaaaaatacaccctgctatggtttattgccaaatagcaaagatgtaaattacatctccgacactgacatgccactacattattaacagggccacggaggccattgaaagtacactgtatgcacatttacagtagaggacatattaaatggtaagctttagtattttagtatatttaatttggcacacttgttgctgttctttgtgaatgttaatctttcaaccaatacagcagcatgtcagtatcttcatttgcagggtataataggcttatatcctgaaacaataaacttataatagcttgtctgttgcttggtggagatgtgcgtattcagcacgaaggtgttgcatgccctatttttgctcaaggttctttacacatgcccttcctttcctgtcaggaacacaagccacatttataagtttttgctataataccaactacatagtttggaaattttccattgtagtacaattcactttctttttccattattgatataattataactaggtacatctatatttgaaatgtgaagtgagcattagactggtttttaatattacattgagactgatttctttttttagagacagaagtaagatttggaaaaggtgcacgcttgtagtataaaacagaaatgtacataaaagatcttaatacagattacttctttctaccaatggtaatattcaacttggtattcatcagtgggaaggtttgaatccattctatttaactactttcttttctgactaatttcatctctgcaatacagtagatatattattaagaaccaaaaattgaaacaaaacatttataggtcacttaataaaagatttctcttccaaatattctaaaatggtattaacacatattctatttagaacccttacttcctgtgatctgttatattaaaacaattgaggtataaatttctagataaaagggcattactctaaaatccctttcaaaagattgcagcctcagttgtacactcgcatcgaatgaccccagtgattgtgctgcttcattgcattttacttctgacatttctgtcctatgcacaagattgaaaaagatcaaatttgatttgtggcagtcactacttgttatcttcaaataagtatttgcagattaaacaaagcatgattctagaagtaagcattactgagcctattttagaaagacttttgtaaaattaacccatttttttttaccatcagacctatgtggtaggacatagaatgcctgtcgcacatatttccaaatgaagtgtgactttagaatgtgctcctcattatgcaggtccaactcagcattttaaagcttttcaaatcaagtgcattggcaccatacacttaactgaatttttcgaagattttatggttattatctaaaatactgtactagccaatctattattttctcagattgtgtttcagttttagtgattaagtttctgttttgcaaattgatacaatattgaggattacatatattttaaacacacatacagataacacacacacacattacccctatactattaaatctagaacttactgaccagtgtaagtttttcctctacctttgggaaccttgagcataatagctttgttcattagattatactattaactacagataattaaatgttactttagaaactgctgtaataaagtgatttaggcttaccaatttaaatcatacaagccttattaaaatagtagtaaaattccatttatctcttaaacaactttaaggactttttggaaaaacaataatgtatttagtatactcccctttaaaggggtttctgattttttttttctcagcagtctaaaggcagcacagagcattccgtatattaatttcaaaacagattatgtttcatattaaatagaagatgacatatttcaactattttgtagtggagaataaagcatggaaatttatcagcctggctattctattgtgactttttttctaagttgaaatgcttccaatgacattccccaaagaacgatttttacatgaatgatcccatatatatgtgtgcatgaatatgtgtgtacatatatatgtaatttatttggtaattttttttggatttttaaaattttttttacttttgtagaaatgaggtcttgctatgttgtccagactgatctcaaactcctgctctcaagcaatcctcctaccttggcctcctgaagtgctaggattacaggtgtgagccattgcacccagccaacttttggtgcttttgaacactactcagctttccaagagggattcatgatgggcatgacacctccaaaaaatagagtgacttagggcaaagatggtagacaatgtttgcttgtgttaaggagttttgcctctcaaaagtgcaaggttttttataaaacataggaataattttactttataggattgatgcgttaaatttaaaatctatgaaatgccattcactattcatgtcacatggtaaatgctcaatgaatggtagctttcattaatattactaataagaaagtagttgttaaatatacagattctatagccaaattatttctctactatttcttagctatttatccttttcaagtcaattaacttctcagagctgcaggttcctcttctataaaatagagataaaacttgcctctcagtaattaatatatacagcataaagtgcacaacaaaactatgaaaagtgttgctcctattttcttgtcccatagaggatgtgtctttagttattgaaggttaaccaaggaattagtagtgttttgtgcagaaccgggttggaggggagtctggaaagacaactaagaaacaggtaaacattataaaagttaccagaaatattacaaatgttattacttcatgccactaataatgcagtttagaactgaaggagctgcacaacttagccaaaatgtaacaagaggagttgagggaacatggaaagaactggattatgagagtgcttggtcaagatgggtggagattatgccagaagtcaagaaagttactggtatggaagcacccacctgttacacaggagttccatcctaccatgcatccgggatggctcttaaagctgagagagagccaactatgaatgaaggagcaatgctattgtatggcagggggttgaataagggatagatacagactgtgggctgcaatggatgctacaggacgttgcccaaaccccctttaagaccgaagcactcgttctccaactgctgggagtgttgctggctgatcactgtaagtgaggtctaccaccttggaattgaaatcacccactgaagaacagagtggcttcatcaagtgtatggaaagcagcctctactcaatgtctgtttgatgtggatggtataaagatttctgctcttgtcttcaaggtgggtcagctctgaatggacactggagtccggcactccctgtggagtcagctgaggtcctggttgtgaccgcattgcagtttaacacctcttctgccaatcctactttattctactccctaacagactttttagttttcctttttgtaaagatacataacataaagtttaccttgtaacaatttttacatgtacagttcagtggcattaagtacacttttactattatttttcaaccatcaccacaatccatctccaggtctttttcattatcccaaattgaaatttgtaacctttaaacaatacctacctattctccctaccctcagctctggcaaccaccattttactttgtgtctttgtaaccccaagccaatttccatcttttaatattcatatttaatatttaatgatcaactaaaataaattgaaatcaaattattgtatcaaatgtttttcaaaataaaaaattttacctgggaatacaaaaatatataaatatatttttatgaagaacccacagtttagttaagaggtcatagtatgacaaacatccaagaatctcattttttttctcctgtttttttgttaaatctcctgtttttttcttaaacttttctattgatgctcacttgatgtgtcataattttagccagataatatttttgcatctttcttttactgtctcttcattattttgttggtaacactcttataattcattttttaaaatactttgattcttgcattcatttacagttacaattagtttgcactctcattgatctgtttcttggctcctgttacagattccctggaactagtccgctacttttatctgacttatttcctgcttttcatgaccaggtatcaagcacactctcttccagttgtacagttggaaagactgaactcaaagtctgaacctccatgttcagaaatactaactaactgtgcaaacttgaatcagctttttccttccaacttttattttaggttcaaggggtacgtgtgccagtttgttacacggataaattgcaagtcacaggggtttggtgtacagataattttgttacccacaatatcagcataatacctgatgggtagttttttagtcctcaccctcctcccaccctccatcctcatataggtcccagtgtctgttgttcccttctttgtgtccatgtatactcagtgtttagctcccacttataagtgagaaatgtggtatttggttttctgttcctgtggaaccaattctttaatgtattttagcttcattttctacatatgttaactggaaatcatcatcacttctcactcaatactataggtgacataacacagcctactttttattttaaaaaattatttttaagttccagggtacatgggcaggatgtgcagattagaaaattttttaaaaaatattttgtgtaaacaatttaagaagagtatagaagccaggatgtttgctgatatacatgacagttgatattggaatcttttgaatgttcatatatgtgcctacccattgaacagcctggttgcaagaagtttaaggcactagaggaaatacacagagaaattagacactgcaattgttaataaagctctgtggtaccatgcctagtggcttcacagcaaataagtaggaattagtagtcttttctgggttcagaggccgatttaaaattttagattttaatgtactatgagctttacaccttctaaggtcttttgcagtgcaattttgccaatattaattattctgaacttatccttgtaatttgtatttttacatctgctatatccttttgatttattgctttgatcttattttaggttcagcaataaattttggttgaggtcctgatcactccagttaatttagtgaactacaagatataaaattattttaagtaaaatctcctcacattttcaccgtggtaggggtcagggagagttcttacatgaaatatttaagaaacatctgactataacccaaccagcatgtggagaaattacattatttcttagactattttaacatcaaagctctgaagtgaaggatagtcattaaaagccgaattactgaaagcatatctggttagtgcacttaaacacatttcggcagactaaaataatttaaaatctgaagtgaagtgtgatccagaatcacatatgtcaattactatgttgtctgtggtattaaaaatgcatgcagctggaagcttcaattatatgagatttctgacttagagatgctttgacttttactttttgaaaaagtcaccttttcagaaatccaagggaaaacatttgtaaaatgcatagtgccttttccaattacctcttattgaaagacagaacaacactagagagttataaaagtgaactgaaaatatgattttgtatgaaatttgattagtgtttgttgaaaccttatctaggaaaagtaaatctttgtgccagacttttcttcctcaagtcccgatctcattaaaacaaatgtgatccagtattttttgtattctctcattataataaatttagagtttaaaattatatttttcaagtaaattttggacttatatctcacaaataggtaatatttattttcttcccattaaaacaaaggcacgcaaaattaaaatatgatatatatcatatataaatataaatattacaggctttttattgtgcatttcctgtatgtcaccagatcctttttttaaaattatcttatataaagctacatgagttgcttctaaatatgtgactaatagttacattattagagtgatggcactaaaacatggactgctatggtttaaatatgtccctaaattcagatgttgaatcttagtggacagctgggtatggtggctcatgcctgtaatctcagcactttgggaagctgaggtgggtggatcacctgaggtcaggagtttgagaccagcctggccaacatggcaaaaccctgtttctactaaaaatacaaaaattagccaagtgtggtggtgtgcgcctgtaatcccagctactagggaggctgaggcatgagaattgcttgaacctgggaggtggaggttgcagtgagccgaggtggtgctaatgcacttcagcctgggcaacagtaagatttcgtctcacaaaaaaagaaagaaaaagaaagaaacttagtggccctagtgatggtactaggaggtggggtcctcaggaggtgattaagtcgtgagggtagagcctacctgagtggaattagatacctttataaaagggcatgctggaaagagtgtatcgcttttccttttgcaccttctgccctgtgaggacacagcatccttcccatactgaggatgcaatgttcaaggcagcacctggaaaagcagagactggactctcaccagacacctgacctgccggcaccttgatcttagacttctgaacttccagaactatataagaaataagtttctgttcgttatattacctgatatgtggcattgtattatagtagcacaaaacaaactaagaaatggaccttgagaaatcatgaaaccatcccttaaaacaaacaacaaaaaatcccagtaacatatatttttattttttagggaacagatgatgtttttaaaaaccatgttgtcttcagatttcaagtcagtttaggtctcagatacagataaggaacatgacatttctgaagcacatattttttccttaaaaaaatctgtgttatttgcaaaagatctagtccctctgatttctatttgctggaatgtccttccttttttccgtctccaaattcccaggcacaatgcagcccttcacacttcctggggaagcaagctgcacagtgacccaaaccacactcatgtatgttggagtggttcactgatttgatggttttctctcgtataaatgatatttttcatctccaaaaatgagcctgggctgacttttgttcagaatcaaagagagtgttggaataaatctcctcttcaagtagcaggagaaaatcaaatgtatctctcattaaataaaaagtcagtgtgagttttggaactcttcctattagctacaaaacatgtcttataggatccagaatgaggatgtgaaagaaaaaaatgacctaattttctaaagggattttcacataatagttgttcggtagagtgccattgaaaaggtctatcaagtagagaagatattgatattctttaagtgatgaggaaaagtgacattcttttcacagctataaattcagtctttggccaacattctttttattcatttcaggtcttgtttttttttttttcttataaaaatgtgagaacatggcatcgttttcaattggatattttaccttatgtggcatgaattatcactttcctcactgaacggcatgcacattgctatttcttggattgcacatatatttgtggtttttatttaaggtcaggaattcaaggccccaagcatgggatgagattccccttaggcagcattgtgacaccaacatctcccattctgcacactgccactgccttctccccaaaaatatacttcatttttcctgaaatagttaagtaaaatggctattctccagataattttaaaccaatctaaaagcaaacaatttagtcgttttccatcttttccccacctgtgctatagaagttaccagtatttgaaactgtggccttaagcctcagcagttttggtgctcccttttcagtggaataattataccaaggaacaagctgaccaggttttgaatggaaatgtgcctgctactgtaaaagcaggccaggggattctggtcactctgcatgctttcacccaagaccatttttatcatgttgattctaatcatgggtgtagtcacgtaaagtccaatgttcgagttttgcagtacccccaagaagactgaagactggtatcatgaaatccttctaatgttaaaaataattttaatgaattgtggcatttaccttaatgttttggggtttttattttagaagattttgacaggggagtaattcctatgtttttaattacactacttcatagccaaacagtatcttggaacttgcctttttctatacctatttagctgacgctaaatcaattgaggaatgtcccaagaatatttagcatgttattggtccagctagagttgtcttcagttctattctaacattgttttctgctgtactaggttgtacattttacaaacaaaaatgggtttccaaagatattatattaggagattccctaaaatgtcaataataaagaaaaccatgactttattactctcttcacaaatcttaattcctatatagagcaattaaaatcatgctgttatctgatcaacggacaacagctgaagcagagaatgcctgggcctccatactccctgttagaacaaggtgctctgtggtgtcatgctgacagggcctgggaacagaagacctgtctatctgtaaactacatagtggttgttggatctgaagccaagcacttaacctctatttgagaaaagattactcacatatgtaaaatgaaggaaatatcttacctgcttcacagaatggtagtttgataatacttataaaatattgtataaaggtatagttttgaaatttaaaaaatcatgtaatgtcaaattatcgaggataattatcagcacgatctgctcagcagaaatatggcacttgcctgttaccccaccttgtactatatataagaccctagatttctgttccctgattgaaatatctaaagcaagcagatatacaatccttgggagagccatttttttttcaatatccaggtttaggcaagtgatatagcactgtgcaagcattttagagccaaagtcaacgaactaaatcattaagagactctctaaaaacaaatttacctatgttttgtaaccaactttttatgttacggtgacagataactcatggaacttgagcttctacctaaacattttcagttccaccttgtcacatcatagaagtgtgttttttaaacctctggtgtgatttttatcatttactgatttcaatacagtggtatctccttagaacagattaaaccttcatgcattttaacgtattctcctgaaagtattagacctttatcactacgtctagaaagaaatgtgtatttggaggaatatttcttctttttaataaatatgcccctattcatgttgcagtgccattcctctaaatttatatagcatatttttgtatcctgtcatcatggcatttgttttgtgattggcctgtattttcccaggtagtaattactttacatactaatttgctacacacacacacacacacattcacacatacacataatttgcttgcttatatatttattctgtataaatatcctgatacaggctactttttcctaacaagtatttttaccacccatttgttaaaatcatgcaggcattcatttgattcatgcagctggtgataaaccagctctatttgcaggcctcacgcatgcatttggctatgtcaagtgacatgattcagttataagtgcattcaagcatacatttacctctgaatccttgagtgttcttgaagcaagccacagagctagctgtactgcactgcttcatagatgaaactctaaatcaatagttttcagaggtatgaatatatataattattgtgtgatattatttcatgtttcaaaggctataaaaagtagatttctcagatcagaagatgtgacacatttacacatgaaggatactttctaatactcttatcctctctgaaaatctatgtaaattgtaactgctaacaagaacactgatattcacatatagtcttacatgagaatttcatgtttatatacagaagcaatagattcaatacgtactcaatgcattctatatattaaggtttgagatacatacaagctaaaagaagacaaagactgtagcattaaaacaaagagctttccaagttaataaataattttagttataaaggtaattacaacttactgttatttggaaatagagactagtagctaccacttctttttcttttcacttttttctttcttttttcttttttgggtacatagtagttgtacatatttatgggattcatgtgatattttcacacaagcaaacaatgtgtcatactcaaatcagggtaattgggatattcatgacctcaagtatttatcatttattttttcttttatttttatcataccacttatcactacttgacattttcttatttatccattttcttattgtctatatccttctagaatgtaagtaagtgtcatgagggtatggacattttttgccctgttcaatgctctatctaagatgttcagaaaaattcctagcacgtagtgctaagtaaatattaaattatgaagaaaatataacagggttcacaattttagtttctggaattttccaaaattatatgtcattattattattatgctttttttaaagctacaataattatatcttttacttggtttttattatttttaaactttacatatatatgtgcatatttatgtagcattatgttcacattcttatattttgaaggaacaatagcaaacttaaagatgcctcaaagatatataatatataatacatactattccccaaagaggtaagaatagagatggagtaggcaataccaatactaaggaagtcagcagagagtagagcatttttatttctgggaaagggaaccacagaagaaatactgcctagtcacttagtcagttgttttcctgcataaatctgtcagaagaaagaatcaaagataatgtgtgaaaaagtcccacatatattacagaaacatttgaaaagttactactataagaagtagtgagtagggtgaattatgagcttatttcaagactctaatctggtaatgctctctccctgaaacataattttaaggctttgatggttttactcctacaatttaaaaaaagagaagagtgtatccaaaatatacaaagaactcttaaaattcaacagtaagaaaacaaactaatttaaagtggtcaaaagatctgctttaccaagaaagatatacgaatggaaataagcatatgaaaagatgctcaacatttatccttaggaatttgcaaattataataacaataagatgccactatacacctaagagaatggctaaaacaaaaacaaataaaccaaaaaaccctgacaataccaaaatctggctatggtgcagagcaacaagaactctcattcattactggtaggaatgtaaaatggtatagtcactttggaagagtttggcagtttcttacaaagctagaaatatagtcttttcatatgatttaacaattgcatgcctacatatcttttgtgcatttacacagtgatgaaatattccatgttaaaaagaaatgtgtaatcaggtcaccaaaggataagaataaatcttaaatgcacattggtaaatgaaagaagccagtctggaaaatgtcacatactgtataatccaactatatggtattctagaaaacgcaaactacagaaaccataaaaagaccagttgcttgccaagagaccaaggggagggggtaggtaaaaagtagagcatagggggtctttagggtagtgaatctatactcaatgatgctttaatagtagatacatggcattttgcctgtgtcaaaaccctcagacctttatagcacaaagagtgaacattaataaagaaaacaaccatttgggaagtcaaggaatcccaggaaagatacaggttgagacatgagaatctaagcgtattgcaattgtatgaaacagcctcgatgaagaggttcagtttggggagatactgatgtaagtaactttgaaaaaaatgaaatccaaaaaggcaaaaggaaattcacataaacctgtaccatagttaacaaaattacttttcatgggagtagagcttcattctgaaactgctttttggggatatagaattgatcaattaagtaaatggatgacacatggtgggaggcgggattcccatggctgaagtgtgaatttacagataagcaaggaaaggagggtaaaataatccacgtggtaatgaaattaatttgaagccataagtacacatgtttaacctaatacagatgatttcatagagaaatactttagataaacgtatatacacaggttagtatacacgtatggatttctctgtccatttaaatgagaggatctgtaagaaatgacacaccagtagcaatgagcatgcctagtgctcagatcttagtttctcctaacattctttaataaaaaatgacccattggacctacgagaaatggctgattatagggctgtgatagtaaatatacaaaatgtgtctgtagtactttgtaatttcagaaaattctaaacacacgcacacacacaactttgattgggagtatgtcaaaggagcacaagagcaaactaaagagctcccaatgtccaaagtgcaatgctagaggaatttgagcaacaaaataaataaaatagtattagattatgtcaacatataaaatggatattcctgactctatatatttacagtaaagtattgaacaaattaacagagagaacttaaaatctcccatgcagaataatatttttaaataacttatgtaggtactccatcctcaaggagggaaagcacatctcctcacttgttaaatgtgtgctgcacaaagtaacttccttccagagcccagcacagaaacaggatagaaaaggggtaattttacagtgcagaaaaatgacaaacaccttctcagccaggtgataaaggtcaacattaacagtgataaatcacgttgttagtttgcactcttcacataatgcgatgaatatggcactttatttctctgacctttccccccagacccataaccccaatccaatcatgaaaaaaacaaattccaatagaggaacatcctacaaaattcttgaccattactcctcaaagctgtcaaggtcatcaaaataaagtctgaaaaactgtcatagctaacagaagcctaaggacagatggcaattaaatttaatgtggtgtcctggatgggctctcttaacagaaaaaaggacattagggggaaaactaatgacatgtgaataaagtctagaccagagttaataataatgcatcaatattggctgactaattgtgacaaatatctcgtactaatgtaaaatgttactattaggagaaactgggtacggggtaaatgggaactctctgtactacttctcaatttttctgtcaacataaacctgttctaacaaatcaagtgtatttgtaaatggtaggcagaagataaacatcactctgaggtaactagaatgctatttttgaagctgaataacttgttttctaaaatactgagtaacattaatcaaaagattatgatgcacaattgtttaccctgtgagctgcatgtgactctattcctgagctgatcaccaactcaacaatttttcttatgttcaaacttgcagaacctaataatgtacatgttttattctagattcaagcattaagcactgtgcagttttgagagaagaagttataaagcaaaactgacttgagtaaccaccagcccaacattcgggactttgtggggattgctatggctctgccggacttacaagcaatagtgatgcagaacctgtcattagcatgtgtaatgcttgtcaaaaaataatctcccaagaaatgttttaattttcactggtcagtgcactaccaatactagttttggcatggcggataataaataacaaacctttgtttcgaatacatgtttgtccagtttctactttttgctaaatcctgtgaccatgtgctcccacttgatagcatgttatatggtactagtaaattttacttgctgtttaataaaggaggattaaatgaatgctgtgctacagtgggtatactgacagggaaggcatgatagaaaactgtctaaatacaactgagggaagaagaaagtgttgaagggaaggtgaaaatgtgcactgaggtttgatgggtgagtaggacttcagagagtggagaaggccctatggctttttaatggaaacaatagcatgagataaatgtcagggctatggaaacgcatactgcaccagggcaatggttgtaagtctgagatggttgaagaacagggtttaggaagagataccgtgaaaagtaaagcttagaactgagacaaactgtctccagctctggattctcagttattccatttgaaacctagtaatataaacaacttgaatccattacaaaggttttgatctgacttgggctttggaaagagatttctgactttctgtagctcaaaactctaagcaacttagttttcttctctactctttttttctaaaataaggataatgatacccatctgactgaaattttatgagcataatgcaaaattcaacatggaatccatggtgctttacaaaataatgtgtgttgtctctccacagaatgaagtagtatttgatactattaacatagaattcatgaaaatagaaaaaagaacacttcttgagtggtgaaaacttcccagtatggtaaaagttaattagaatttgtgtgaattatactgtgtaattaccaaggcaagcagagtattaatatgaatttaaaatagtaagagtaagattaaaggcatataatttagttcaaatgtgacatcttgacaacctgcaaaaattgctagaaatgaatggttcttaatattaagaaatataataaggattggttgattatttaataatttagataatttacataagagttattgcaatgtgggaacagtgttcttgttaactgattgtattgtgtggttatgttaccgactacaaaaatttaaactaaggggaaagaatcactttactctctttttatgtgaaacgacattactctcactgtattgttatagttgtaaatcctaatattttgtcaagtagaaaacataatctctaggtgttatgtggttccttgacttaatctagtcctgatgtactagcccttattattatttttaagcctgttgattttccttggtccataatcaatcttatatttgacattttaaaaaacttaaaaagttttatatgtatattatatatatataactcatcaaatgagttttatatatataaatgagatatatataaatataaatatatatatacacatacacacacacacacacacacacacacacacacctcatttgatgacctgaaagcatgaaagcatatactgtatgttctggacttgggtttatggaataaaaatgtatgatttttaggaaaatgttatgtttctggtccagctgtattctgttcactcattccccaagttaaataaaataatttgtgttcattttgtttctgagttagttttcatcgtataaaattggaatgatcctaattttgactccttaaacaatgttaaaggaataaaccatgctattttttttaaagaaaagctacttcaaattcctatgctttgtaagatacagtggatcaatataaatgagcaaggacgtatagaccaatttatttaatgtgtccaaggaaatagtacatttcacatttgtgctattttcaaagtgatcctggttaattaaaaaacaaccacaacaacaaaaattcaaagactataagcctaacttgatccttcaaagctgtaaaaaaaaagtgtgattaaatatccaaacagagtttctatgttttgttactgtggctgtctctttgatataggtattactgaagtatgtgaaacaatagaaattcttaaatgcatttaagctggtctatgaatttataaggtctatgaatttaggctaaacatgtaacaaatctgcactgttaagcaacaataaaacatacacttattcaagtaaatacaaagaaacaatgacatctctcaggaagagaaagaaaataagattggataaattttaaaaatgatacctctaattttatttttgctcattcttttatagtgtgatatgttttttagaaatcatgtcttgatatttcttttaacatctcaaattggctctttcttatgattttctatttctgtaaatgtttagttgtgatagagttctctacattcatatatatgtatatatatgtgtgtatatgcatgcatatatatacatgtgtatatcaccaacatcgtttttttgttggtaaccataacaaacataaaaatgtaattttatatactttatatgtttacaatattaaagccttaaaatatgttctatataatcggtaatatatgccaagtaatatataatgtgggatatatttaatgtataatatatagatatgaaatatgatagaaaatgtataataataacatagaatatattaggagtcctatattgtctattctgaattacatatataatcatgtcttatttatttataacaaaccaaaataaatgataattaaagcagaaagcctgctttgcttagataaaattcacactaatttttagctaaaattttatgttgtcataaagagatgatttaaaatctacggagtgagttaagggtctgatgtcactcttctgcatggggatattcagttttctcaagaccacctactaaagagagattcttttccccatggtgtgttcttggcatttttgttgaaaaatcattggattaaagacttaaatgaaagacctgaaactgaaattacaagaggaaaacacaggggaaacctaaacaatatgtgtctgagcaataatttttttatttaacccccaaaagtcaggctacaaaagcaaaaataaacaaatgggattttttcaaactgaaaagattttgcacagcaaaagaaacaatcaataaagaaaagaggcaacctacaaaataggataaaatatgtgtacattgtgtatttgtacaaggggttaatattcaaaatatatcaggaactcaaatgcattacagcaagaaaataaataatgcatttaaaaaaatgagcaaaggacctgaataaagattgtttaaaagaagacatacagtggccaaaagacatattaaaaatgctcattatcactaatcatcagggaaacgcaaatggaaaccacaatgagaatcacctcatgtctattagaatagccattttccaaaagatgaaagagaagtgttggtgaggatgtacagaaaaggaaatccttgaacactgttggtgggaatgcaaattaattcagccattatgggagcagtatggaaattccttaaaaaattatataacaaaacctgaatatgatccagcaatcccactgcttgatatgtatctaaaagaaaaggcaatcagtatatccaagacatatctgcactgctgtgttcactgtggcattattcataatagttaagttatggagtcaacctaagcatccaccaatggataaatggataaagaaaatgtgatatacaggctgggtacagtgactcatgcctgtgatccaagcactttgggagactgaagctgcaagattgcttgaggccaggagtccgagaccagcctaggcaacacagtgaaaacccatctatacaaaaaaaccgtaaaaattagctgagcatggtggtatgtacctacagtttcaagtactactatacaaattctaaaatttgtatgtagaaaataccagttatatgactcgggaggatcccttgagactaggaagttgaggctgcagtgaaccatgatggtaccactgcactccagcctggatgacagagaaagacccactccaccttaaaaaaaaaaaaaaaaaagaaaagaaagaaaaaaatgtgatatacatacacaatggaatactattctgccttaaaaaattgtcacttgtgactacatgaatgaacttgaaggacattatattaagtgaaataatccaggcacagaaagacaaatacagcatgttctcatatgtgggaacaaaaacaatgaaactcacagaagcagagagtaggatggtgaactaccaggggatggcaggtggggatctgggggagatgttggtttaagggtacaaaatttcaggaacacgagatgaataagttcaagaaatctattgtaccgcatagtggctatagttaataacaatgtattgtatactggaaaattgctgagagtaggttttaagtgttttcaccacaaaaaattatgtaaggtactgcatattaactagccatttcataatgtatactctacaaaaataatgttgccctatatatatatatctatctatatatatatatatatatatatttgtcaattaaaaatgtttacttaaaatttgtatgtagaaactaccagttattttgaaaaccttgaatttataaggattggtaaacatgcacatttagattttacaatgaaacaaaataaggcaagcatgtatatttttgtttgctttaaaactagtttatcataaattttgaatgtgttgaatgcaaagaggaactggaataaaatttttaaactattgtcttccaatatgctgttcaggatctcttgtctcagcttctttttggaatattatgcatagctcacagatttccagccactttgagtcaaaagaagtctcactttgagaattaaaacacatatcaaagctaaataatgaaaaatctcaatatggaatttaaagcttaagtatcatacaacattattatttttcctctcccctcagttcaggggcctgcagtagggacaagggttgtggtcttttcctcactctttcttctatgtcttccatgtcatgctggtagaatcttcaggatggatgtcaggtaaattggaatggaggaaaagaaacaaagtgctttataactggggctattattactctgctttcaataaccttttcgaggcagacattcacatgctatgtctcccataggattcatttctttctctttaatttgaactcttgtgactctcctgcaaatcctgcatagagaacctaattactaagattttcttgcttgaaaagtttgcccccttggctggttatttttaggacagctcaatcttgtctgtcttccatagtgtccatttgacccacacatccttcatatgtccacaaaagggattcagtctgtctgactgctgccctctgcctcttccggctactgttctgccctcaggattctacaggaaaggagcagcactagtttctatgtccatacatgtccctttcaatgtcctgggggaaaataaaatgctccattctttgaaaacacctttcacagcattcccactgctgttccacgctgtacctaaaagtttatgcaacttggtgcacatctgcccaaaaagttgggtgcaagtctttccttttgtagagatctctgagcatttcctttgaatatcaccttcttttttccgaagaagccaccttatccccaattctcccaaggagcactaggctaaaacttcactgctctatccaactcttttcaattttattcagtgttaatttccacaaactctagatttctagtctttaaaatatagactgggaggacgagagtgtgcatcatagaactgtttttttttttttggttttttttttgtttgtttttttgtttttttttttacctttaagaagccttggaagaagtgtttagcaacaacttatatctctctagtgtagggtgcgtatctctttctaatgtctagagtgtaatcatctcttgctttccgtttggggccttttaccaaattataataaagtggggatacaaaaacaatttaataaagagtcacagcattgcaattaggagaccaatagaaagaagtctgctactgatctttttctgttgattaatctactttctattcagaaccaaataaccaaacagaagtttagacacactgcccatgtgtacaggtagtcatgtatcatagaaaaacaagccacctaagtcactgtattcgtcagggttacctggagagacagaactaataggatgtgtgtgtgtgtgtgtgtgtgtgtgtgtgtgtatgatttatatatataaaggggagtttattaagtattaacttacaggatcgcaaggccgtgatgcaagcttaaggagcaaggagagccagtgtgagtcttaaaactaaagaacttggagtccaatgtttgaaggcaggaagcatccaacatgggagaaagatgaaggctaggaggctaggccagtctcgccttttcatgttttcctgtctgttttaaattcactggcaactgattagattgtgcccaccagattaagggtgggtctgccttccccagcccactgactccaatgttaatatcctttggcaacagccccttagacacactcaggattaatactttgcgtccttcaatccaatcaaagtgacactattaaccacccgcagtcactgacctacaataggcacagattgtgttatttctattaagattattgtttctcatgtggcttatttggcttgtctttctcattttagaaattcattccttttctctttattgtaaatatttactattatttcttcttcccattctttagcagttgttctattattattacagttgggttaaatctgaatgattaaaaggtaggaaacattgatatcttagtattgttttactgtgctcaaattgtattgcaagtaatcagatatatctattccctaggaagacttaagatgttgttgctcattgtctgtaatgtagaaaaagtagcatgttatatttaaattttgattaattggtgacaagttgaatggctctgcagactctcaacaacattcgggtttgaattcaaatgagcacattttcaaatcacctcaagcactatacttttcctcccatgagcattagaataaggtattttgaaaataaaaatgagaagttgtattgcaattaaagatttcaatgtaatttagtagagataggcaatattctaatagtgaaatataatgacatttcaaagctcccagtgcagttttataaaaatttatatttcttcacaaattatgaaaaaataggttactgcagaaaacaccttttgcaaagccatggtaaaataaaagaattttccacaaaattatgaaggacaggggtgaaaagaaagaattatggtaaaataaagagaatcagttgccccctgataggtctttacttcacaaacaaagtttgtgaattgcatatggatgtatttttgatccacatataaaatgttctggaatgtttgtgcattattagattgacagaaagttacagtaaaattgtgtttttggtgtaccgtcatgtttttgatatagcccatagcactttaaaaataaagcataaacaggttaaatggaaatcaccgaaaatatttatcatggaaatactaatttcactaaagctggtaggtaactatcaccatcagacaaagctaacttgagataaaggagtattatcagagagaaacagaacttttgaaccacgaaaatatttgtaagtcaagacaaaccttgtaccacaaataatgaaaaagaaaaccttaaaatcaaatagcagaaacaatttaactcaactggttattaatattttatataattacacacaagtaattaacttataaaacctttgaattcagtaacctaaatatagacctttagtaagcaaagtctccaaggaaatatgtgtttgatgcaatgtttcccttagtttagaaatatctgtaacaaggctggttcaacatatgcaaatcaatcaatgtaatccagcatataaacagaaccaaagacaaaaaccacatgattatctcaatagatgcagaaaaggcctttgacaaaattcaacaacccttcatgctaaaaactctcaataaattaggtattgatgggacgtatctcaaaataataagagctatctatgacaaacccacagccaatatcatactgaatgggcaaaaactggaagcattccctttgaaaactggcacaagacagggatgccctctctcaccactcctattcaacatagtgttggaagttctggccagggcaattaggcaggagaaggaaataaagggtattcaattaagaaaagaggaagtcaaattgtccctgtttgcagatgacatgattgtatatctagaaaatcccattgtctcagcccaaaatctccttaagctgataagcaacttcagcaaagtctcaggatacaaaatcaatgtgcaaaaatcacaagcattcttatacccaataacagacaaacagagagccaaatcatgagtgaactcccattcacaattgcttcaaagagaataaaatacgtaggaatccaacttacaagggacgtgaaggacctcttcaaggagaactacaaaccactgctcaatgaaataaaagaggatacaaacaaatggaagaaaattccatgctcatgggtaggaagaatcaatatcatgaaaatggccatactgcccaaggtaatttatagattcaatgccatccccatcaagataccaatgactttcttcacataattggaaaaaactactttaaagttcatatggaaccaaaaaagatcccgcatcgccaagtcaatcctaagccaaaagaacaaagctggaggcatcacgctacctgtcttcaaactctactacagggctccagtaaccaaaatagcatggtactggtaccaaaacagagatatagatcaatggaacagaacagagccctcagaaataacaccgcatatctacaactatctgatctttgacaaacctgacaaaaacaagcaatggggaaaggattccctatttaataaatggtgctgggaaaactgtctagccatatgtagaaagctgaaactggatcccttcctcacaccttatacaaaaattaattcaagatggattaaagacttaaacgttagacctaaaaccataaaaaccctagaagaaaacctaggcattaccattcaggacataggcatgggcaaggacttcatgtctaaaacaccaaaagcaatggcaacaaaagccaaaattgacaaatgggatctaattcaactaaagagcttctgcacagcaaaagaaactaccatcagagtgaacaggcaacctacaaaatgggagaaaattttcacaacctactcatctgacaaagggctaatatccagaatctacaatgaactcaaacaaatttacaagaaaaaaacaaacaaccccatcaaaaagtgggcgaaggacatgaacagacacttctcaaaagaagacatttatgcagccaaaaaacacatgaaaaaatgctcatcatcactggccatcagagaaatgcaaatcaaaaccacaatgagataccacctcacaccagttagaatggtgatcattaaacagtgaggaaacaacaggtgctagagaggatgtggagaaataggaacagttttacactgttggtgggactgtaaactagttcaaccattgtggaagtcagtgtggtgattcctcagggatctagaactagaaataccatttgacccagccatcccattactgggtatatacccaaaggattataaatcatgctgctataaagacacatgcacacgtatgtttattgcggcattattcacaatagcaaagacttggaaccaacccaaatgtccaacaatgatagactggattaagaaaatgtggcacatatacaccatggaatactatgcagccataaaaaatgatgagttcatgtactttgcagggacatggatgaaattggaaatcatcattctcagtaaactattgcaagaacaaaaaaccaaacaccgcatattctcactcataggtgggaattgaacaatgagaacacatggacacaggaaggggaacatcacactctggggactgttgtggggtgggaggaggggggagggatagctttaggagatatacctaatgctaaatgacaagttaatgggtgcagcacaccagcatggcacatgtatacatatgtaactaacctgcacattgtgcacatgtaccctaaaacttaaagtataataataataaaataaaaaaaagaaaagacaaatgagtaaacatgttctcattgttggtagctaaagttctcactctgaaagaaagccagaaaacgtatggaatgagagaaaataagaatatgtcctttaccttgttttgaaatagagatataagtatgattcatatttttagcagaaaacagaattctgcagtagcaatgagcacacctattactcaagtttagtcttataaataatattccccactataactaaccattgtttcttagagaaatgggggcctctggactagtgtagggaaattataagttgaaccgaggcaagagtgctaatacattagagaagttatggtaaagcacagcaaccaactggaaggaattctcattggccacatttgggacacttggagggtaaaaaacataacagtgttgaattattacccatttaattagaaaaataattcatgaatctataatagcactcacaaaaataggaagagaaaaagaacgttctcttgaaggaataccagctaaggaatgtagagaggtaaacagaaatagcaaatcaacaatgcaatattagattcaggcagcatcctctgagagaaaacacactgagaaaaaggatagtcacacaatctcagagtatcttctacagattgcttagagaaaataggttcattcactaatttagtatcatcaataatgataaataacagacattgcttattacctaatgtgatgtgataggaatagtgctacacacctatagagtattcttgctcaaaatctttaccctgagtctaattgttagaagaaaaactcagaaatatacacattgtgtggtaaagtacaactgtgaaccttacaactaatttggactgtaaaaaatattaataacatgtcaagttcttggacattaaaaaaaaagcctcagtagattttgagattaaaagagatttatgagatattgtaattagttgtatgacccttaattggaacccagattgggaaataaaaacctgcagaagacatttttagaaacaatgggaaacttggatatggactgtatagttgatactttaaatgaaataaagcatgtggtttttactattactgtagttctgagagcaatgtatttgtaattgggacataagtgtattaaaatttaggtgtgaagtattaggatatctgcagttactttcctacttttagacaaaaaaattgtacagagagaaagacaaacaaatgtgtaaattatttttaaatcacttgtgaatccaggtgagttgtttagagtttttctactattctataattttacttcatgtctctattatttttcaaaataaaaattggacaaatgattcactgtgtataatttaagggatcaatttttacaaagagccatgatatctcaatgaaaagagaagcctacccatttttcatcccaagaaaaattatatcaaaattcaatttaaaagacaggttccagaaaaatcctcatatttaaaaaacacactattatacaatgttaattcagatatttctctacttattaattcttttaaaattaagaaaagcaagatatatagtttgttagagataaatgtttatttttttaaaagtgtaaatctgaagagaaacctattctattgactattctttaatatgtcccactggaaagaataatatgagttacagagtgttgcaacctttagtttatttttaaatcgagaggaagcttgctacatttcaagaaagttaccaatagaatagtatatttggacataatgtttgtaattaactgttgtgcactgttcaggtttattactaaaatttagtttcatttattctgtgtttttaaaaaatctgaggactattttttaatgatttatgcatctttgactgctgaccatgttgtgttacattctaccaatggcatggataagctagtctataatttaaattcatttttgattagttattatacctaaataaaatagtgtagactatactatgtgattcctaaaacttatataatcaatttttgccaattccttgcctatccaaacttaaaatactaagaagatagtgtttcccttagtgaaattttaagtgtggaatacctacaaaattgtgcacaaatcatgtgtgtgtgtgtgtgtgtgcacgtgcgcatgcaattcagtaaattttaaccaactctgcacattcaataagctcccaggtcaggaaatattaccagaaaaggacgcttgtcatcagcatccttttctactattggtcatcactgatctcatttctaacaaagatgagtcatttccaagatgatgatcaaattcacaattataccataaattttatgtccattatagtgttaatggacctttggattatgtctaggttttaagtgttacaaatgatgcttctataaaaattccaggacatgtctttcggttctcatataaacgtactcttgttgacatacaccaatgaatagaattgctggattagaggatattaatattctcagcttgagaaagtgctctcacagttaccacagtgatgttaaaaatttttattccttttatcaatagatgagagtgtggattgcttctctttcccaccaacattattttctacatctttctattttagacattctggttgggttataatggtattggcttataacatgaatttgcattttccaataaataatgtaatggtattggcttataataagaatttgcatttctaataaataataattccaacagaatagtctattttgacataatgtttctaattaactgttgtgcactgttcaggtttattattaaaatttagtttcatttcttctgtgtttttaaaaaatctagggactattttttaatgatttatgcatctttgactgctgaccatgttgttgtgttagactctaccaatgtattttgaactttgtatttgagtgaagtttttcatgttacagcttaaaagatttcacctttttttaacttataaaatactgtgtaaaaaccccctttatctctgcttcttaccctatccctgaatcttacattttcaaagcctccggtaagatgtgctcctttgaaacatttactcaaaacaaaatagcctatgtttttagagttttaaaaaatgtgtaagatgatatagttgagcagcctatttcatgtgtttttagtcattagaattattcattagggaagttactatcacatctttctcttataaactcttattagatatttgtactctggctatctggtttcatttggtaggttgagtttttaaaaataatctgttttttagagtagttttgcattcactgcaaaactgaatggagagtacaggtaatttccatatattccttgtacataaacacaaccccccactactgacatcctgcactagagttttacattttttataattgataaacgtgcattgacgtgtcatcatccaaagtccatagcttatattcaagtttactgttagtgttctatatgctacgagttttaacaaatgtataatgacatgcatacatgattatagaccccagagcagtgacactgcactaaaaatcctctgtgctcctttcatttatccttccctccccacaagatatggaaaacactgatatttactgtctccatagttttgtttttttcagaatattatttagttggaatcataaaatatgccatttcacattggtttctttcactttataatatgcatttaaggtttcttcatgtctgttcatggattgacagcttaaatttcttttttgtactgaataatattccattgtctgctgttgtatctagtttctttatccattcacctactaaagggcatcttggttgctttcaagttttggcaattatgaataaagcagcttcttgaccaactggacctaagagacatctacagaatactccacccgacaaccatggaataaacattcttctcactcacacgcagaacgtattctaagattgactacatgcttggccataaagcaactttcaataagttcaaaaaactcaaaatcataccaagagtatgttcagactacagtgcaataaaaataaaatcaaagccaatgaaaactgaacaacttgcttctaaataactcatgggtaaacaatgaaattaaggcaacaatcaaaaacattatttgaaactaatgaaaatagagacaaaatttaccaaaatctttgtgatgcagttaaagcaatgttaaaagatcatagtgttaaacaccgttatcaagaagttagaaagatctccaattaatgatctaacatcacactgcattagtttgttctcacattgctataaagaactatccttaaaaatttttaaagaaaagaggtttagttgattcacagttctgcaggctatacaagaagcatggctgggaggcctcaggaaacataatcatggtggaaggtcaaaggggaagcaagcaaatcttcgcatggtggcaggagagagcgaacaaagggggaggttctacacacttttaaacaagcagatctcatgagaactcactcactatcatgagaacagcaagggagaaattcgaccctatgatccaatcaccttccacccaactccaatacttgagatcacaatttaacatgtgatttgggtgggaacacaccaacaggaactagaacaaaaaaagcaaaccaacccctaagctagcagaagaaaagcaataactaaaatcagaaaagaactgaatgaacttgagatgcaaaagtccatacaagagatcagtgaaaccaagagctgtttcttccaaagaataaacaaagttgatagagcactagttagattaacaaagaaaaatgagaagatccaaataagcttaagtgcaatcagagataacaaagatgacattataactgatcccacagaaacacaaaagatccttagagactattaagaacacgctatacatacaaattagaaaatctagaggaaatggatcaacttctggaaactacaatctcccaaaattggaccaggaagaaaacaaaatcctgtctacacaaatggcaagctctgatattgaatcagtaatttaaaaactaccaaccaaaaaaagtcctagactacatggatgcagccaatttctatgagtcatacaaagaagagctggaaacaatactattataactattccaaaaaaatcaaggaggaggggctcctccctaactcattctaaaattcagcctcatcctgataccaaaatctggcagagacacaacaacaacaacaacaaaacttcatgccaatatccttgatgaacatagatgcaaaaattcttagcaaattattggcaaattgaatccagtaacacaccgagaaattaattccccatgatcaggtaggttttactcctggaatacaaggttggttcaacatataccagtcaacaaatgtgattcaccacataaacagaattaaagtaaaaaaaccataatcatctcaatggatgcaggaaaagctttcaataaaatccaacaacccttcttgataaaaaaaaaaaaagatcctcgatagaataggcatcagaaggacatacctcaaaataataagagccacctatgacaaacctacagccaatatcatactgaaccggcgaaagctggaaacattctccctaagagctataataagacaaggatgcccactctcacttctcctgttcaatatagtactttatgtctaagccagagcaatcaggcaagaaaaagaaataaaaggcattcaaatgggaaaaagaagtcaatctatctctcttaactgatgatataattctgtagtttgaaaacctttaagtctctgcccataggctactggaaccaataaatgattttagcaagatttcaggacacaaaagcaaattacaaaaatcaatagcatttctctacaccagtaacttccaggctgagtcaattcaagaatacaatcccatttacaatacccacaaagaaaatgatatacctgttaatacagctaactaaagaagtgaaagatctctacaaggagaactacaagacactactgaaaagaaatcagagatgacaaaaataaatggaaaaacattccatgctcatgtattgaaagaactaatgtcattaaaatggccatactacctatagcaatttacatattcaatgttattcctatgaaactacaaatgtcattcttcacagaattaaaaaaaaaaaaaacaaaaactattctaaaacttatgtggagccaaaaaagtgcctgaatagcaaagcagtcctaagcaaaaagagcaaagctggagacatcatactatccaactccatattatattacaaggatacagtaagcaaaacagcatggtaccggtataaaaacagacacctagaacaaagaaacagaagacagaaaccagaataaagccacatatctacagctatctaatctatgataaagtcgacaaaaatcagcaatggggaaaggactccctattcaataaatggtgctgggctagctggctagctatatgcagaataataaaactagatcactggccaggcatggtggctcacgcctgtaataccagcactttgggaggccgaggtgggcagatcactaggtcaggagttcgagaccagcctggccaacttggtgaaaccccgtcactactaaaaatacaaaaattaactaggcatggtggtgggcacctgtaatcccaactactcaggaggctgaggcaggagaatcatttgaacccaggaggcggaggttgcagtgagccgagatcatgccattgcactccagcctgggagacagggtgagactttgtctcaaaaaaaaaaaaaaaaaaaaaaacccaaaaaactagatcgctaggttttaccatagccaaaaattgactcacaatggatgaaagatttaaagtaagacctcaaagtacaaaaatcccagaaggaaacctaggaaatatccttcttgacatcagccttgagaaagaatttatgattaagtccccaaaagcaatcacaacaaaaataaaaattgacaattgagaattaaactaaagagcttctgcacagcaaaataaactatcaacagagtaaacagagaacctacagaatgagagaaaatattagcaaactatacattagataaaaatctaatatccagaataggacagtaaacaaatcaacaaacaaaaaacaaataatcccattaaaaaatgggcaaaggacatgtatagacacttttcaaaataagacatacatgtggctaacaaacatatgaaatcactaatcatctgagaaatgcaaattaaaaccacaatgagataccatcatacaccagtcagagttgcttttattaaaaagtcaaaagacaacagatgctggcaaggctgcagagaaaagagaaagtgtacacgatgttgatgggaatgtaagttagtccagctactatggaaagcagtttggattttctcaaagaacttcaaacagagctaccatttgacccagcaatcctattactgggtatatacccaaaggaaaacagatcattatattttaaaaaatgcacttgtatgttcattaccatgctattcacagtagcgaagacatggaatcaacctaggtgcccatcaacggtggcctggataaaggaaatgtagtatatatacaacgtgcaatactatgcagtcgtaaaaaagaataaaatgttctttgcagcaacgtggataaagctggaggccataatcctaagcaaactaatgaaggaacagaaaatgaaatactgcatgttctcacttaaacacaggagctaaacattcagctcacacggacaaaaacatgtgaacaataggtactgtggactaatagagtggggagggagggaaggggatgtgggttgaaaaactacctactgggtatattatactcactacatgggtataatatacccttgtaacaaacctgcacatgtaccccctgtaactaaaataaaagttgaattctttaaaaaaatgctgctataagcatcccttttcaggtttttgtgaagacataaatttcaattcctctggataatcaccaaggagtgtaattgctggatcctatggtaagcgtatgtctagtttcgtaagaaactatcaaacttccaaagtggctttactattttgcatgaccactagcagtgaatgagttctgttgtttcacatcctcactatcattttgtggtgtcagtgttttggattttcaccattttaataggtgtgtagtggtatctcattgttattttaatttgcaattgtccaagacctgatatcaagcaccttttcacaggcttacatgccatttgtgtattttctttggtaaagtgtttgtttgggcctattgcccatttttaattgggttgtttccttattgctgggttttaagacttatttttgtattacagttaacagtcctttatcaaatatgtctttagcaaatattttcttcgagtctgtggcttgtagtctcattctcttgccaaaaatttttaattttcatgaagtccagctcatcaattcttttatttatagatcatacctttggtgttaaatatgaagtcatcaccatatccaaagttatctagattttctcctatattatcttctagaagatttatagttttacattttacatgtagattattttggcttggtttaggggaaggatgtaagaactatgtctagattcatattgttttgcatgtggatgtttggttggtccagcactatttgttgaaaagatttcttttctccattgaactgcttttgcttctttgtcaaaagtcggttgacttcatttgagtgggtcttttcacctgttccattcatctgtttgtgtattctttcaccaatatcacatagtcttgattactgtagctttatagtaggtttgaagttgggtggggtcagtcctctaactttattcttttccatcaatattgtgttggctatttgggggtctttttactctccatatgaactttagaattagttttttaatagccacaaaataatttctgttgagattttgattgggattacactgaatctatagtaaaattgagaagaactgacatcttagcaatattgaatattcttatccctgaacataaaatttctccatttattgagttcttttctgatttctttcaccagtgttttatagtttttcctcacataaatattgtacatattttgttagatttatgcttaagtatttcatctttttgggtgttagtgtaaatggcattgtgtttttaatttcgaatttcagttgttcattattgatgtagtaagtcacgaaagcaattgacttttgtaataataactttgtatcttgcaaccttgctataaattcttactccagttttttttgtcagttcatttagatcttctacatagacagtcatgtcatctgcaaacaaagacagttttattttttccttctcaacctctatattttaatttccttttcatgtcttactgcctagcactttcagtatgatgttggaaaggaatgatgtgaggggacagtcttgtcttttacctgatctaagtggaaaaacttatttttaaaaaacgaagtctgatgttagctgtaggtttttttgtagatactctttatcaaattgaagaggttccccagtactttaatttgctgacagttgcatttctttaaaaaatcaggattaagtattgttttgtcaaatgacttttctccatctattgatgtaatcatgtgatttttctttgtatgtttattgatgtgatggattatattagtttaattttgaattttgaaccaatcttacctacgtgggatgaagtccgcttagttctggtgtataattctttcataaattattcatctcaatgtgttaacttttttctgaggatttttgcatccacgttcatgaaagatattgttttgtagttttcttttcttataatctccttgcctaatttttgtataaggctaactctggtcttacagaattaattagaaactactccctctaattttgtcttctagaggagattatagagaatttgtataatttttttcttaaatgcatggtagaattcactagtgaacacatgtgggcctgaggctttctgttttggaaggttattcattattgattcaattttttaagtggacatgcctattcagattgtctatttgcaggttcctttttcattctcttaaagctgccttttgaaaaatagaaattcttaattttaatataatgtaattcatcaatatattgttgaaggattaatgcttttgggtcctcttcaagatatctttgcctactctaacatcacaagaatgctcctctaagttttgtcatttgtttgatttcaaatttaaaaggcaagaaaaactttaatgcatttagaatagaattttgtgcacaatatcaagtaggcattactttaggacattccattgaattatcaccgttagttgaaagtccatgtttcccctctaaactgcaatgtcactgttgccataaaccaggtgactctgtttgtgtagaagtatttcaggactgtttttctgatcacttaacataattttcagataataaatgtaattaaactagcattataatagatcctaagtcttccagtgatgtactttttccacaatacaatcttgtttgtttttggtcatatgtatttccatatgcatttgagttagtttgttgatttcaacactgacatctctctctctatatatatagttattatgattatttacaataatatataattattacaattattatagttataattttaataattgtaataattcatggaatgaatttgtatcacccagataaaaaatacatttaataatcttttcatatgttcattgctctttattttgtatgtgattgcagttttttatgtcacgctgtatagattcttttatattttctgtgtttatgtcagatagtgccttttttcattcctttccaaattgtatccacatttaaaatatttattctccatttcgttttggctagaatgacaagtgtaatgttgaatagaaaggcatgattttaaatatccctgtcttttcccaaattctagaggcaaggccttaaaattcaccatgggaatatggtatttagtggagattttacacatgtttttattagacatagatactaagaatttcaaaatataaatgactgacaaattttatcagatgtcttttctgtatctattgaagacaagtatttttctccgtcttttgacatagtcacattgatttctccttttttgttattgtggcagaatatattaaagcattaatacattaatacatcaaatactaaatgaccaatcttcctacaaatagctggggtagattatcttgtacataattatagatttatttatgttcttttttccatctatttttacaagagagatacttctagacatttatttccagaaattattttggaaatttcatttttttattatcttaaaatttattttaacgccaagattatgctagctttattaaaatatttggtaaatattttcttttttttatcttgtcttcaagactttgtatacaactgatgttattccttgagtgtttcaagaaatttgtagatggagtcatataaactagttattttccttttgcgatggtgtttaataatgcattcaaatttcttcaatagatgaaatatgcaaatcttttattattctgtcagctttagcatgtttatcctaattttcaaatatattgacatacatttattatgatgataatattaatagtgttgtaatgtccccttttaaatgttggcatatagttatttttgttttcttttttttaaattaataagtgatatgaggtgtttatcaagtttatcaatcttttcaaaaaatcaacttttggctttgtctaacttttctattatacattttttattttttagatttctacccatatctttattacatctttttacataataagtttaatttgcttttttcctctaatttgaattagaaaacatttcaaatcttttgttactcatattcttttgatatattcatctaagccagtacattttattccaactatgctttaattataccctgcaagaatttatatgtttagtattcagctaaatattttctaatttccattgtttctcttttgaattctaggattttctaagatatgtggtttgatgttttcacacttaggaattttccagttatcatttcttagagaaataaaaacattttaatattttaaacattttgaggatttcctttgacttagctataaaatttggcaaatgtttcatggcaaccgagaaaaaaatatattttttgttgttttttgatgccagattctttctataggaataaaaatattttaaattatattttaattaaagaggctgagaagggaaaggaaggaggatgagaagaaggtaatcaagggtcaaacatacagttagataaaaagaataagttctggtatccaatagtacagcagagaaattatagttaacaataatttattatatatctcaaaatagctagaaaagaataattgtaatgtttccaacagaaagaaaagataaatgtttgaggtggtagataactcaattgccctgacttcattattccacattgcatatacgtatcaaaatatcacacataccttcaaaataagtacaactctcatatataaatgaaaaataaaagaaaatgattccttgttcacttttcccttccttctatcagctactggaggaggtgttaaagtattttttaatattgaaggttactttttcccatcaatttgattaatttttgcaatatataggtaatagctatgttactaaatatatagaagtttgagattacaaaatagttataattaattattacaaaatttttttcttttagctagtaatgttaactgcttttaagtcacatttatttagtctttccatggcatatcattttccaagattttctttcaacccttttgtatcttttatctttgcaacaaaacttttgatagatttaggtttagaataaaatccagctctacaatattagtgcctaattttgagaatttaccacatattccatataactgaaattgctgagttttacctataattttattacatgttttccatttgactcacttattttaagatcctaccttccctcctatgttgtcttcttttaaattaataaatacttttaattgttccataattccatttaataatgtgatattctttcatttttaataatttaattatgttacggattacattacatattcttacatttttcagtgtaatacaaatatttctgcagtaaatctacatgggaacttcagaacacattgctccttcaggtgcttttgctgtctgcataatttcctctctcaatacattcaaaactccacaaaacactactgttgttttgagtagtcgatatttacatatatttacaaatttaactccctttccagtattcattattgcctcttgtaatcatatacatagataactatatagttgtgtgtgtgtgcatatatatatatatatatatatatatataaaacataactataaattaaatgaaaactgttttttggctgcatagaccagcttctgatatctgaatcaaattaagatgttaaatattcatagaaaccaagttatagatataaaattaagttttaaaacactttaattcaatagtgattgctagtcattttagggcaaacaatctaataataaattggcacattctccaaattgcttggcaattagtaaaattgttaaaaagaatgcatttttttaagaatagaaatttttggggggaggagccaagatggccgaataggaacagctccggtctacagctcccagcgtgagcgatgcagaagacggtgatttctgcatttccatctgaggtaccgggttcatctcactagggagtgccagacagtgggcgcaggtcagtgggtgcgcgcaccgtgcgcgagccgaagcagggagaggcattgcctcaccccggaagcgcaaggggtcagggagttccctttctgagtcaaagaagggggtgacggatggcacctggaaaatcgggtcactcccacccgaatactgcgcttttccgacgggcttaaaaaacggcgcaccacgaaattatatcccgcacctggctcggagggtcctacgcccacagagtcttgctgattgctagcacagcagtctgagatcaaactgcaaggcagcagcgaggctaggggaggggcgcccgccattgcccagacttgattaggtaaacaaagcagccgggaagctcgaactgggtggagcccaccacagctgaaggaggcctgcctgcctctgtaggctccacctctgggggcagggcacagacaaacaaaaagacagcagtaacctctgcagacttaaatgtccctgtctgacagctttgaagagagcagtggttctcccagcacgcagcagctggagatatgagaacgggcagactacctcctcaagtggggccctgacccctgaccaccaagcagcctaactgggaggcaccccccagcaggggcacactgacacctcacacggcagggtattccaacagacctgcagctgagggtcctctctgttagaaggaaaactaacaaacagaaaggacatccacaccaaaaacccatctgtacatcaccatcatcaaagaccaaaagtagataaaaccagaaagatggggaaaaaacagaacagaaaaactggaaactctaaaaagcagagcgcctctcctcctccaaaggaatgcagctcctcaccagcaacggaacaaagctggatggagaatgactttgaggagctgagagaagaaggcttcagactatcaaattactctgagatacgggaggacattcaaaccaaaggcaaagaagttgaaaactttgaaaaaaatttagaagaatgtataactagaataaccaatacagagaagtgcttaaaggagctgatggagctgaaaaccaaggctggagaactacgtgaagaatgcagaagcctcaggagcccatgcgatcaactggaagaaagggtatcagcgatggaagatgaaatgaatgaaatgaagcgagaagggaagtctagagaaaaaagaataaaaataaatgagcaaagcctccaagaaatatgggactatgtgaaaagaccaaatctacgtctgattggtgtacctgaaagtgatggggagaatggaaccaagttggaaaacactctgcaggatattatccaggagaacttccccaatctagcaaggcaggccaacgttcagattcaggaaatacagagaatgccacaaagatactcctcaagaagagcaactccaagacacataattgtcagattcaccaaagttgaaatgaaggaaaaaatgttaagggcagccgggagaaatgtcgggttaccctcaaagggaagcccatcagactaacagcagatctcttggcagaaaccctacaagccagaagagagtgggggccaatattcaacattcttaaagaaaagaattttcaacccagaatttcatatccagccaaactaagcttcataagtgaaggagaaataaaatactttacagacaagcaaatgctgagaaattttgtcaccaccaggcctgccttacaagagctcctgaaggaagcactaaacatggaaaggaacaaccggtaccagctgctgcaaaatcatgccaaaatgtaaagaccatcgagactaggaagaaactgcatcaactaacgagcaaaatcaccagctaacatcataatgacaggatcaaattcacacataacaatattaactttaaatgtaaatggactaaatgctccaattaaaagacacagactggcaaattggataaagagtcaagacccatcagtgtgctgtattcaggaaacccatctcacaggcagagacacacataggctcaaaataaaaggatggaggaagatctaccaagccaatggaaaacaacaaaaggcaggggttgcaatcctagtctctgataaaacagactttaaaccaaccaagttcaaaagagacaaagaaggccattacataatggtaaagggatcaattcaacaagaagagctaactatcctaaatatatatgcaccccatacaggagcaccaagattcataaagcaagtcctgagtgacctacaaagagacttagactcccacacattaataatgggacactttaacaccccactgtcaacattagacagatcaacaagacagaaagtcaacaaggatacccaggaattgaactcagatctgcaccaagcggacctaatagacatctacagaactctccaccccaaatcaacagaatatacatttttttcagcaccacaccacacctattccaaaattgaccacacactgggaagtaaagctctcctcagcaaatgtaaaagaacagaaattataacaaactatctctcagaccacagtgcaatcaaactagaactcaggattaagaatctcactcaaaaccactcaactacatggaaactgaacaacctgctcctgaatgactactgggtacataacgaaacgaaggcagaaataaagatgttctttgaaaccaacgagaacaaagacacaacataccagaatctctggaacgcattcaaagcagtgtgtagagggaaatttatagcactaaatgcccacaagagaaagcaggaaagatccagaattgacaccctaacatcacaattaaaagaactagaaaagcaagagcaaacacattcaaaagctagcagaaggcaagaaataactaaaatcagagcagaactgaaggaaatagagacacaaaaaacccttcaaaaaattaatgaatccaggagctggttttttgaaaggatcaacagaattgatagaccgctagcaagactaataaagaaaaaaagagagaagaatcaaatagacgcaataaaaaatgataaaggggatatcaccaccgatcccacagaaatacaaactaccatcagggaatactacaaacacctctacgcaaataaactagaaaatctagaagaaatggataaattcctggacacatacactctcccaagactaaaccaggaagaagttgaatctctgaatagaccaataacaggatctgaaattgtggcaataatcaatagcttaccaatcaaaaagagtgcaggaccagatggattcacagccgaattctaccagaggtacaaggaggaactgataccattccttctgaaactattccaatcaatagaaaaagagggaatcctccctaagtcattttatgaggccagcatcgtactgataccaaagccaggcagagacacaaccaaaaaagagaattttagaccaatatccttgatgaacattgatgcaaaaatcctcagtaaaatactggcaaaccgaatccagcagcacttcaaaaaggttatccaccatgatcaagtggcttcatccctgggatgcaaggctggttcaatatacgcaaatcaataaatgtaatccagcatataaacagagccaaagacaaaaaccacatgattatctcaatagatgcagaaaaagcctttgacaaaattcaacaacccttcatgctaaaaactctcaatcaattaggtattgatgggatgtatttcaaaataataagagctatctatgacaaacccacagccaatatcatactgaatgggcaaaaactggaagcattccctttgaaaactggcacaagacaaggatgccctctctcaccactcctattcaacatactgttggaagttctggccagggcaattaggcaggagaaggaaataaagggtactcaattaggaaaagaggaagtcaaattgtccctgtttgcagacgacatgactgtatatctagaaaaccccattgtctcagcccaaaatctccttaagctgataagcaacttcagcaaagtctcaggatacaaaatcaatgtacaaaaatcacaagcattcttatacaccaataacagacaaacagagagccaaatcatgagtgaactcccattcacaattgcttcaaagagaataaaatacctaggaatccaattacaagggatgtgaaggacctcttcaaggagaactacaaaccactgctcaaggaaataaaagaggatacaaaccaatggaagaacattccatgctcatgggtaggaagaatcaatatcgtgaaaatggccatactgcccaaagtaatttatagattcaatgccatccccatcaagctaccaatgactttcttcacagaattggaaaagactactttaaagttcatatggaaccaaaaaagagcctgcatcgccaagtcaatcctaagccaaaagaacaaagctggaggcatcacactacctgacttcaaactatactacaaggctacagtaaccaaaacagcatggtactggtaccaaaacagagatatagatcaatggaacagaacagagccctcagaaataatgccacatatctacaactatctgatctttgacaaacctgagaaaaacaagcaatggggaaaggattccctatttaataaatggtgctgggaaaactggctagccatatgtagaaagctgaaactggatcccttcctcacaccttatacaaaaatcaattcaagatggattaaagacttaaatgttagacctaaaaccataaaaaccttagaagaaaacctaggcattaccattcaggacataggcatgggcaaggacttcatgtctaaaacaccaaaagcaatggcaacaaaagccaaaattgacaaatgggatctcattaaactaaagagcttctgcacagcaaaagaaactaccatcagagtgaacaggcaacctacaaaatgggagaaaattttcacaacctactcatctgacaaagggctaatatccagaatctacaatgaactcaaacaaatgtacaaggaaaaaacaaacaaccccatcaaaaagtgggcgaaggacatgaacagacacttctcaaaagaagacatttatgcagccaaaaaacacatgaaaaaatgctcatcatcactggccatcagagaaatgcaaatcaaaaccacaatgagataccatctcacaccagttagaatggcaatcattaaaaagtcaggaaacaacaggtgctggagaggacgtggagaaataggaatacttttacactgttggtgggactgtaaactagttcaaccattgtggaagtcattgtggcaactcctcagggatctagaactggaaataccatttgacccagccatcccattactgggtatatacccaaaggactataaatcatgctgctataaagacacatgcacacgtatgtttattgcagcattattcacaatagcaaagacttggaaccaacccaaatgtccaacaatgatagactggattaagaaaatgtggcacatatacaccatggaatactatgcagccataaaaaatgatgagttcatgtcctttgtagggacatggatgaaattggaaatcatcattctcagtaaactatcacaagaacaaaaaaccaaacaccgcatattctcactcataggtgggaactgaacaatgaggtcacatggacacaggaaggggaacatcacactctggggactgttgtggggtggtgggaggggggagggatagcatcgggagatatacctaatgctagatgacgagttagtgggtgcagcgcaccagcatggcacatgtatacatatgtaactaacctgcacaatgtgcacatgtaccctaaaacttaaagtataataataaaaaaaagaatataaatttttatgattttaagatagtgctatataaattatctgtaaaatatactacaaacatagtggctttaaaaaaaaaaagacacatctttattctctcacctatttctattgaacaaacatctcagcatgatttatctcattcttccactcagggtctaagaagggtgccttctggaatcagccaggccacatttttatctggaggcttacctggagaagaatccacttgcaagcttggtcaggttgttggcaaaatttatttccttacctcggtagtaggactgagagctctagatttttcctgactgtcacctggaagctacactcagctcctggaggctatgcacagttcctccacgtgtgttcctctccacgagcagtgagcaatgtggtggcttgcttcttcagagccagctggagagcacaatggtgaatctgctagaaagatagtatatcatataaagtcctataatgatgggagtgacatctcagcactttaccatattttagtggttagaagcaaattctatctttcccacactaaagcgaagggattataaaaatgcataagcaccaatgggttggaaaaatgagagcatctcagattttgtttgccacaggatcctatcattaacgtggctcttctaaatacatagtttcaaaaataaacttgagtctattaagaaaaggaaaagtaagtcaaatcagagatttattcattatataaataatatatccatcttcaaaaatgtgtttcaagttttgtatatgtgtgtagaaatgtttcagagaaagtttagaattctatttctttatgaaattttaattgttaacttcaacatttaatctttgtgtgtgtcttcgctaaagataaaaaagaatcatttagtttaaaacctgattatttactcagaattgcatttttcctcaatactgtatactactggtatttaaaactccagttaaagtttccagagaagaaatcttaataatgagagaatacttgattcaacatctataataactttcaattcaccatttaaaatatttttagtcttagggcttttgtttttgtttgacaggtatttttattctactttctcttgactgttattgctgattcttctccaccctaaggacatttacacttcatcacaagaagctagatggaacattctgaactgcttattcctttagcatatttgacacttactttgacttgggtacaaagttagaaatttgcatttggtttcctttatgatgttagaaagtttaaaatgcataaaataacatgaaactgttgcttatttttgtgtaactcataaaatatatttgatagattaatttttgaaacgtacatatgtaatctattaagatataataacataaatataaatcaggtacttaaatacgctaataatttaaagcaatgaggtattgatcattttatactgaatttctttgtgaacatgctgtgcctttggacactcagattaaagcagagtggatatatgaaaattagtaacagatagctttccccctttccatatttgattctaataattcataattaacataatgtttacttaaaacagagtaaaagaatgtttctttcttcgtagcataggtgaccactataggtaaacaaattgtctaaatgaaattggcggaaagtattaagagtacatccaagagttgtttccttggatgactagattcgatggaattggccaatggattcttccttaaccatacgcttattgcacgcactgaggttctgatattaattcaagttttgatcagactacccaaatttttatgaaccacaactttaattcaaaacttgaatactagagcacttgttattcagctaataaatattttataatagtttattttgaatatttttttctggaattttgggggatacattaggaaaaaagttgaaagaaatgttgaaagacaaaagttgaaagaaaatgctgatctatgtggtattaaaattaaaattcactttctgaaccctgcttcaaaatgtgtaaccaactgagagctccttttgaaatcattccggtcttcaggcagatcccaaactcagctatttcaagaaagttacttgcctagagtaacattttttttttccttttagtcaacactggagagttctctcttaccacttctgaaattctttaattttttattataaatgagacatagatgatgtgagcctttgatttatgaaacatttccagtcactgtcttatcatatgccatgtaataattatagatatattattagcattgatataaatataagcaaaaagcaatcacagaatatagaagtaaagtgcacaggcttttgagtcaaactgatttggtttcaaaggctgtatcttggaagcagcctgaccttgggtaagttaccagaatcatatttaacgtacaacattaatgtgaggattaagtgaaggagtgtatgaacaacatttagcacagtgccttcccaaagtattctctgatcactactttatgattactgatactactgctgttgctactataattactataatatttctaatcccccttctctaattattgctctaaaactacaatccacatggtaaacttgtagcaatcctcacatgcctaaaggtcactaatgtgaagaaatggctgcaaactatcgcaaggacaaaaaactaaacaccacacgttctcactcataggtgggaattgaacaatgagaacagttggacacaggaaggggaacatcacacaccggggcctgtcacggggtggggggagggtaaagggatagcattaggagatatacgtaatgtaaacgacgagttaatgggtgcagcacaccaacatggcgcatgtatacagatgtaacaaacctgcacgttgtgcacaggtaccataggacttaaagtataataataataataaaaaaacaatcagacaggactttccctttaggtaaaggtggactaaaaaaactgctggactgacccacacacacctatatactctataattattaatttaaaaagcaaatacttgaaggcactggagaatggacaaaaggcatagattttggtaggacattcacacgcagaggagggcataacagagtgattgcacccatttttgctatgtttagactaaaggcaggaacagttagcaccaaatagtgaatatcagtggaaaactcagtattgttggcctgagaaaccaagaaattgaatgtcaggcaactacgaccactgaacagaaaaggcaaagtccaggcaactaaagagccagacaagtgatacctaaattacaacatcttgcatacctggctgacgactcaaccattcacttacagaccagaatgaatgcattcagctaaaattaaacgatcaaaactaaaatcatgagtggctacccaaaaaagaggcacattttgcatccaaacaacctgtttgctagaacaaaagaaatgacacatcagaaagttaatgagtaaatgcatattctccacaatgtaacatgaataatgtccgtgatacactgcaacaatgatctaatatgcaaataatttataatgtgggatccattttcaatattaaaaaattaactgagaccaaacccctgagataaaccagataacattagcacatgaggattttaaaactgctaaaaagaagattctcaatgtaaaaaaaaaaaaagtttccaaagatcaaaaatataggaaacattaatggagcgatagaaacaataaaaattaacaaatggaaattacagagataaaaataaacaataactgaaaatttaaacatataactgttacctcaaggaatggtgataaaggaggcagtgaactggaagatacagcaattaaaactattacttagaaaacaatttaataagtgaatagaggcccagataaccatcagataatatcaaatagtttaatacacacatgatttgatttctggatggagagttttatggaattttgtcccttcaaaacctgtatgctgaagtcctaactcctagtacctcagaatgtgaccttatttggagatagtattgttgcagatgtaattagttaagaagaggtaatgtgaaaataggatgaactcttaattccatatgtctggtgtcttatcagaaggggaaatttggatactcacatccataaagggagattgttcatgaagataaaggctgagatcatgatgatgcttctactattcaaggaatgtcaaagattaacagaaaccaccaaaagctaaggtagtggcattgaacagattcttcatcagagtcttgagaagaaaccagttctgctcatctcatgattatagatttctagccttcaaaactatgagaaactaaatttctgttatttatgatcctcatatctttttgtgatactttattatggcagcctagcaaatgcatacagacagaaaagagaaaatgagggcaaaaatatttgaaaacctaaaggcctatttaaaaaaaaaataatgagagatgtgaagttactgatttctaccatgatataaaacatgaggatgaggataagttcacttttctgatttaaaactttctacattttatgaaaagtagcatagaataaactcagaactaaggaatcacttgaacaattgctaaataacaaaataaaaatgtttagatgaacattaaaatgtgtcaataaataagaggaaacatcagatagaataacatatactaacatgctaccataataattgttacatgaagctataatagactctcataaaaagccaccgattatcataatggataaaaagaagacatgtcttaagtacaatgaaagacagaagttgaaaacaaatgtctcagaaatatatgctatgcaaacaaagaaatcttaagaagtgtagtacaacttttgctaaatagattttagtataaaaataattatcaccttaagaaaagtgggacatttcctagtgaaaaaaattgtcaattcaccttaaaactgcatcaattgtaaatgtgtatgtgacctaataagagagcttcaaaatacatgtagaaaaatggacacaattaaaggacaaattatacaagcccacaaaatacctgaacatcttaacacccctgttttggaaattcatataacaactcgatttaaaatatcagtgaaaacatgtaaccgctgaacagcattattaatcatgtgacctatttaatattttggggcactccacaggcacacattcttttcaagtggatggcatatattaactatgatagacaatacgctgagacagaagtgtcaacaaaacaagatgcgttacaattctctaccataattacaatgaaaaataataaagcaagcgtatcaaaaattttcaaaatactttgaaattaaacaaaaatgatcccaataattcatgggtcaacaaaaaaatcgagcaaatgagaatacattttgaattaaatggaaatgtcaacacaacaaattaaaagatattggagaaaactaaacctagttcttaaagatgttctatgattttaaatgaatatgttaggaaagataaaatatcgtaattcagtgttctaagtatcttccttaacaaacacaataaaccaacaaaaaacaaaagcaaaccaaaaaacccaaacaatgaaacagtgaattatccaaaacataagaagacacaaaatccataaatgggtcaaaaagtttaacaactacattacagaagaagatatatgaatggccaacaagctcaaaatcgctagtcatctgagagattcaaaataacactacaatatcctaacactatatacccactttagctaaaattaaaaaggcatctgttcgtgaggatatggagtaactaaaattctcatactttgcttgcgggaatgcaaaattgtacagtcattttggaaaacagattagcagtcacctgtaaaattcaagctaaaattccttatgacctaacgagtccagttttagagatttactcaagagtaatgaaaatacatatctataaaaagccctgtataaaaaagttgctaacagtgttattcatagtagccagaaattggaaagaatccaaatgtccatcaacagatgaatgcctaacggaatgttgagataagcataatatggacttcacacacaattaaaagaagcaaacaactgacacgtgtaacagtctgggtcaactgcaacacatcatgctaagtgaaagaattcaggtaacacatactacacatgattttatttagatgacattctggaaaaagcaaatgacatcaaaacagatcgattacagctagggttctgggaaaggggcttgagggaaatactcaagatactggtaaaattctatatcttcattgtggtcattgttacatgaacacatacaacacctcaacacttctcaaatcgttcatttaaaataaatgacgttttttggatgtaacatatacctcaataaagctgtcaaaaaacagagcagaagaaaaaaccaaccaaccaaccaagcaaattgtagatttagtaaaagagccagtttatatattaaattagccactaattgtgcctggtttttaataagatgtgtcatgtcaataaaaaagaaaaataaaacatttggcacttgtttttaaatgacctttcaagagagataaagagggctaagaataggctttaattttcaagcattttatgctataacataataaataaataaacatggtggcagcaggggtgtagtggttagaagcacagactctggttatgcagcaggttctcattttgctgtcatgtcgatgagagaaaaacatcactctccaggagctactgtctgtctggagtctgcatgttctccctgcatctgtgtgggttttctctggggactatgagttcctcccatgtcccaaagctgtgtccgttagtgaactagcaagtctccaggatccccgtgtgagtgagttagggtgtgtgtgagccactctgccatgctttggcatcctggcagtgtgggtcctgtctggttccttaagggctctagccacctgtgaccctgaactggagtaagcaggtaaatacttattttacatgttttatctttcttaaatgtatgtatagctcacatttattttaatgtttattatgacaactattttaggtcattatttagatatttggtgatatttttgtgaccacaaatatgccctggaaatttaactctggttgatgtcaattagcctaaagaaaaattggtttcttatagttgttttgcttttagttgcagtttccaataacctattatatagagcacctttgagataagtaactataatacatcttgaaaaaagactccatcttacatttctacaggcatcatgtcaacagggacaagatggttcacctaatcaataaagactacatccagccagataaggacacaaccaggtatactcttccactaacagtccttaccagaggactctgtgaccttaaaaagagcaggacgccaccaattcaaaaccactgtgttaacagacaccatattgctgtcacttgtgataagcacctagtatctgctgctgaaggctctgcctacatcacagactcttgatggacagatggatgacccagacccaggacaggatactctttttgtccacgtctctccctggactggttaaattaactctttttctgtccccttttacttaatgttaaatgttactttgtttgttgtgatatgtttagtctatgacatttacaaattgattaagtatactatttatttatggtttgcaatgttgaccgacttgtggagtggcttgagcctgtggctgtgactactgagtgaacaggacggattaaggagaattgctcccttggtaactccatggaacttgtagctttcatgatttaaataggattaataaagcctgaccattgtggaaagacaaaaacatgcatgggcctagttatctctgaccttctgtcactcacaataattggcatagtcagtgcttttgctccacagacacattttcaaaactaaaatcaattggcatttataatcacatgactataaaagctaaattaagaaaattcctaaggccaaagcctctactaagacttaaattagaaaccaagctgttttgcaaaacaacctgccactctctctaaaaaggtacataatcttgcttcaccttgaaagcccggctccttagggaaatcttaggtgataggatttctgtacccatgccatgtagactgaaggctgacaaggtcttggttggtgccaagctagaagctggtggagccagaaaggctcatactgagcagggtctcaacaatgagatggtggttgtcaaaacaaacttgtcatttggctgaaagaaaggaaagtgaattatcgcataacctccactcatatggttggttaaggtgagaaactgaaatatttatatattaagaaactaaacagagtagccactaatattgcataatgtgtcggccctaggaaagaatggtcatagagggctcactgtccaaatacgttacttagtgttgaggcacccaacagagttggaagtcaaaaaaggcttcctgtatgatgaatgccacgaggatatactgtcatacttgagggacccctaaaatattaagcccgtaattaccagagtccctagagaagaaatttccgtacttgtaatgcaaagtatctaatagatacacagggatcccaagaaaggcaaatagatagctcataagattttaaggaaaattcctttcagatgtaactttaagggaggacccttgggaccaaatggggacctgggtcccatttcagagaatttagtagattatgatgaccctgcagtggaggtatatgtgtcaagacctatagtaactagaaaacagttatagattataatcacggaaatggcagacctcaggacatcagtgaggaagcagaatacgccagagcagaattacaaaaaataagaacagatttttgctaaagacagaccacagatgtagactggctcctccatctatgggattatggagcaaacatcacagaactatcaggcacaaaaatgcatcagatccctacattagcagaaaacacattactaaatgatcgcctattagaactaaaaaactacccaagaagcatcctatctctctgggattaaatcaattagcctggaaatctgcccactcatatttagacccaacaaaattaggagacagattcaagtggaatgatctaacacaggcacaaaagaatacaaaaaaaaagtcagctatcctagggatggtatacgatagatataaccaatatgcgactccacttgaaattccagctacaaatgaaattaaaagagcacttctattaggagcaccaccaaacctgaaggtctcctacatgaatgctctctcaagcacacatgaccctgcaagatatattatactagaaacttttaaactttctgcagagttaggaacccataaggtaatatttatgacaatcctgatataaacaccaaaagataaattcaggaagtcaccattttttatatatatatatatatatatatatatatatatatatatacacacacacacacacacacacatatatacacatatatatacacacatatatatacacatatacacacacacacatatatatagtatacatatatacatatacgtatacatatatacatacacgtatacatatatacatacacgtatacgtatatacatacacgtatatatatacatatatgtatacatgtatatatacaaacaactctgggacttgtttgaaaaaatatatatatatacgtatatatatacacacacatatatatacgtgtatatatagtatatatatattttcaaacaaatatatatattttcaaacacgtatatatatatatatatatatttttttttttttcaaacaagtcccagagttcactcaaaatggacgtaagccatcttggcaaaataaatcaaggcagatgagtcagcaacccagacaaaacaattgtcaatctaagcaaaataattagcaaccaaggacaaaaggaccaaactggcaataaggctgtctaaggccaccggctagatactaaaatatatgggcaaagacattcttgaggtccaggaccaaacccacaacttcagaaacaataacagcaacaataaagaaattttacaagaaaatttttatcaaaaaactggaacccccttgagtacaagctataacaatcaaatccagggataacaaaccatatgtgcaattagctatacaaattgacaaataggtatacacatttcttttagaaaccatatcacaagtaagccttcttagatataattcctgacattctgacacaaatgtccatatagaaggacttggaggaaaattaattcaaggtttcccaatctctgcttttatacttctctacaactctaaacctataccttgaaatcggtggtggcctattaaaaaacttaaaggaactaaaattctctaatctagcacaaattaaaatgaaacccataacactgcctataccctactgaaaattaatcattaaagggaggacataaagaaataacagcaaaaatctagaatttctcaaggaagatattaaaattggaatttcaaataactttaatagtttagtatggcctgttctaaaaccaaatgggagctatcaattaatgactgactatagaaatctaaataaagtctcacctaaaatgccaagtattaccagatgcagaagtcatcaataagatcacgatctataacggcaaatactatgtaattataaatctgttggacattttctttgcataccaatagaccaagccaagaatataccacctttacttgaggaggcaaatgaggaggcaaacgatatcgatttaaaagtttacatcagggatgtctaaatagttcaggaatagctcttcttttttttttttttttttttttttttttttgagagggagtctcgctctgtcaccccggctggagtgcagtggcatgatcgcggctcactgcaacctccgcctcctgggttcaagcgattctcacgcctcagcctcccaagtagttgggactacaggcttgtgcctggctaattttttgtatttttagtagagacagtgtttcactgtgttagccagcatgctctcgatctcttgatctcgtgatccacctgccttggcctcccaaagagctgggattacaggcatgagccaccacacctggccagctcttccattttattatcacacatagaccagtccaaatatacatctcaaatagtatcatacatagatgacattataatgataaacaagaaccaggaaaaacttttctaaaaacctcccttaataacacgcttaagatcactgggatgaactattaatatagataaaaccacaggcccagacaccagctgtaaattttcatgagtacaatgttcacgagaagggagaaaaatcccgaccacagtgatagataaaagaaaagcccttaaagcatcaaaaaacaggaaggacaaagactaataggtttatccggatattggagacaacatatgccttacttaaacatcatcctgaaaccaatagataacataactagagaattccaagacttcacatttggacaagaacaaaaactagcacttgaaatactcaaaggtacatcactatgtcccagatagtgcattatccatctccagattcacaaattaggttgcaaattctaatgagtgataaatatggaacatggtcaatatggacagaaaaaccagatactaaatccatcctacttgtcgaattttggacaataaaatttccatactctaataacaaatacatcccatttgaaaaacacatgtggcttacacaggaagcctcgaaaatactgagcctctgactggcaacagcattacaataagatgccataagccttgtcttcactggataaaattgagttctgaagaactgacaggtatccaaattgatctaaagctgctcacatggtaatggtacatccaggctttaagggtcaaccaggcctcctcaccaaggacattcacaagactgaaatagactcgccggaatttattctgaggacaagaacaatccatgccaatccaggtagatgggcccagtctggtctaatgtctagaataataccttgtttatagatggatcagctgccacgacccaaggccagacccaacagacagcagcagcactcagacccaaggaccaaaaaatcccgaagacatcaggcaaatcactctctgcacagcatacagaattgattgcagttgttccacatcagacactcagtattagaaaatcaaaagaaaatttacattttatagattcatggatagttgcaagtggcatagccctatggtcatataaatggaaacgaaataatttcaaaattaatagtgaagacatatggtacaaatattactgggaggagatatctgaattatcaaacagaattaagatatttgtgaaacatgtatcagcacaccaaaaagattattcagagatgacaaaatataataggtagatgcactaacaaggaacataaccactgacaaacaaaacatacccaaattaaaactacagggaaattcagacaactcatggagacattcattaccatctctacaattcaggagaaaatcagacaatgaatgggagatactagaagtaccctcagtagctttaatgaaacagggagatgactttaaacagataccagaagcagcttgtaatcaaatactcctataattacataagcaaaaagaacaattgggcatatactcactgtacgggtggctatcagacagaaatcaaaaggtgatatggcaccaagttaaaaagcctatagctaattgtgagcaatgtaaaactacctagatgaatatagaaatactaaacaaaaagatacatacaaacccaatgccttttgccgacagaatttataggaccattaaagcaccactaccaataaaaatatgcagtaacaattgtgaatgtatatgtacatggattgtcatagcaatagtaggcagacatccatctgacaaatataccatctcagccttagaaaattgggtggctcactacaaaacacctaaagtaattgaaagtgatcagcgaaatcattttgcatcaagggctacaaaagcattgacagatcagtgagatataatacagtgcaatttccacctacctataatcccatggcaggaaatctagagagacttaatgaactataaaaagaggatgaaaaaccttagaccaaatgagtatattccaacaaactcttaacctggtatgttttcatttaaatcaaaaggacagactccataagagcaaccctcagtctcatcttaatcaactgactttaatggtcataaaagaaaagggaaaatatgatgcaaatattgtaccttacaaagtgagtactagactaatttacaagactatccctcaatagtgcattctggccaacagacacaaaatacatattggactacaggaaaaagagaagagtcacaattacacaaaatccctactaaatctactgattgctggatgtcagcatcttccagaaacccattatggtcctggataccactggagataagtatttttgataaaggacaacaaataaaatgggatagttaatatttacaggtagtcacagaccagatacctacaatctgctgttatctaactcaccactagtacttggaccatttacacccacatacaaaacaacagagattattagcacattctttacacaagatgatccaagaaacatgatcatattagacaaatttacctataaaaccaaatatgtatgagatcaagttatttttctattgtgcccactgaaattttgaagatgtagatagagacaacatacagtttcaattaattgactggtgggaaacagtaggaaccaaaataaatgtgggaaaagtcacaaaaatagatgcaggtatgtcaaattcctttttctctattatccagccattccacgaatcatagaatatggttacatggtcggcccaacaccctatttacaaaaatataaccagactagactcccatttatgtaaatttatatctaaagtcagctcttttggaaaagctatgttaaaccttgggacactgaaccatgcataattgagacaggatgctggaatgacatgtgtcactaaaagacacaccactagaaaccacagtggaccaaggggacaataaaacctccacctaaattactaaaatcaaatgtatttgaacccatgctaattaacccttaagattaatttacaaatcaacacctaggagagtcaaaatatttttcaaaaactaaacattttttttttttttggagacagagtctcactttgttgcccaggctggagtgcaatggtgtgatctcaactcactgcaacctcctcctcttcggttcacgcgattctcctgcctcagcctcccaagtagctgggattacagatgcacaccaccatgcacggctaattttgtatttttagtagagacagggtttcaccatgttagccaggctggtcttgaacttctgacctcaggtgatccagctgccttggcctcccaaagtgctgggattacaggcgtgagccaccgtgcctggctgaaaactaacaatttaaagtcacaaatatctaaccacgatgtctacaatttgagggacagggatataacatacagctcattttaccaaacttaccaccactagaaaaatatcatttagaaatctgctataaatgttcgcaacaattggatttcaaacttagtcactgcagaaacgcaaaaagcagaaattcaggaagttaaaacagacgtatttaatttgaaacataaacttaattcctacatgtcaactaccacatctatactgtcatcaatttcacaggcacttaatgaaataaatcaatgataactcatacccatgttcttatagaatatcaaaaggaattcagttacaatattgatcacaaggtagacatcgaaaagtcaacatatttacattaagaaaccttatgctgaaaaactagggcgaacacagtggactagataagtactttagtagctcagacttggaacaatataagaaacacaatacaatcgggaaaatcattcatagaaaattgggacaaagcagctatatttcaactggatacatccaaaccatcaggatgtgacgattcagggcaatgtatattcaacctttgtgaattaagaggagaagactcactattggcatattggcacaatgacaaatccacagacaaatgaaagacataatttccaactaacttccttagaaaagccactatttattgatggttattttatataaagataattaatattccaacagtcaaacactatatactatatctttcaggacatactacctaaactagattacttacctatcagcattacaaaaatacccataatggctctagtcttaggaaacttcacttggatagtgtgctcagagaaaaattataacctgattataaccacacaagtcgaaagcaccacaacatacacttgcaattagaatgtgtcaaactgatgtatgtcataaacatcaccctcacaaacacttcaaaacttaccactatatggaagaaacaaaaagtagagatttttgttcatcattgtggcactccaacataagaagaagcaccttgggaagataccacacagacgaagacaaacaagaaaactcaaagaaacttgaacaggctcatgataaattccatatagaattagcacaattaaaatgcactactgagacggtaacacatagaatagcaatattaaacacataaaatcacatttgaaaaatacctagacggcttacactgaagatgtaccttcttgcaaacgatcaaaaagacctttagccacacttcttgtaacagctcatggttagcttgaaaactaataaatatattaaaaaactggattccagaattggtctaaaatctttgagaacatttatagaactttgttatcttcgttgcagtcatcttctttgccaactataaactgaaaaactgcattgctagcctttgtaaaacaaagtttgtaaacaagctgccaagagaaaattaattaccaaggccacttgtaattttttacttttgtaaccccttcctcaaatattgtttgcattgtgattactaaaatcatgaggtggattgtttagagcaccctagacataagtaactccagcttagaagatgacaccatcttacatttcaaaacgtatcataccaacagggaaaagatgggtcaccgcgttgataaagactgcatccaatcagataaggacatcaccaggcatactcctccgctatcagtcctcaccagagggctctgtggccacaaaaagagcaggacttcagcagcttgaacctccatcttaacagacaatgtctcactgtcatttgtgataagcacccagcatctgctgctgaaggctgtgcccacatcaaagacttttgactgatggaccatccagaccagcacaggccattcattttgtccacgtctctccctgcactgataaccctttttcttatcccttttctctcaatgttaaatgttactttgttgtgaaatgtttcatctataacatttttatattaagtacactactacgtatggtttgctatgttgactgacttgtggagtggcttcagcctgtgtgcctgtggctccgactgcagagtgaagggaagcacgatggagaaccgcccgactacagacggaaggggaagtacgatggagaaccgcccccttgggagttccttgtagcttaggagtttcgtgattgaaatagcatcactaaaagtctaacactgtggaaagacataaaggtgcatgaacttcgttatgtctgacctcatgccactcatgatacaatggtttatattagaagtgtttagggtcattatttagaagtttgtgaccggaaataggccataagaatttaactctagtttgtttcaactagcctaagggaaaattggtttcattatagtccttttgctgtttaaagtcacagtttgcaggaatctatctacctcttaagtgataatttactgtatagaccctgaggtcaaatcaaatctgcgccacttaccgtgtgaatttcggcggttgcatatccctctgtgtttgagttttcccattttataaatgctggtaaaaatagggttcctcaataagtttgttgtgatgattaagtagttgtcttagtccatttggtgtttggtgaaaggtaccacatgcaagagaacacaggagagagggcaagaggagcccaactcacttttataactaacctgctctcatgaaaacagtatcattcacgggggcagagtctgcatgacctcatcacctcttaaaggtcccacctctcaacactgttacactggggattcagtttccaacacatgaactttgggagaaatactcaggtcataacctcactttttccacataaagcacttagaagagcacctgctatagtctaagtacacaataaacacaattatcattagaaatcgtgcatggcttgctgaaagaacagtaatgcatgagggaagcacacatttaatcaatttaaatccattcaattttagtgtgggctactgatttagttaattgaggcaagtaaagattcaggtttttcctccagaatttcattttactcaaagcctgaggaattctgtcaggtggttgcgaatgacttcttccatgatttggttaaatctctattttaaagttactgaatacattcaaaaccaagaatatactttataatgaaactgaaaaaaatgaaattcaagagaaaaggcattgtataaataattgagaatgtttgtactgtatttgagcattaatcttgatattgctgtgaataaatttgcccacaggcaaatatgctacttaccaaataagcctttaatatgtacttaaagcaattattaataatatgttataataataccttttgagtacttataatgatgttaaacacgggaattgtgactgaagacagaattttaaaaattagcttctaaaatacccaaaatagatcctttatattcacagtcatataaaaggcaaaatgattataaatggcaaaaacctgaaccccaaatagggaatacattttctagaatagtccttgtttgtgtaaaaaccactgatttcaaaagtcagctactttacagcaaaaaattgtacctctttgaaatcaatgggaatttgataatgcagaaaagggatttcattaggccctgagtaattaattaaaatgacaaatgtgtgtaaatgatgaatatagactattgtaattagagactcaccaggtgtagtaaatatgctcgactttccattttcaaaattgcttataggctaatgataagatgattttccagggctcatctgaaatcccagctctctgcagacaatagattatctgattaaagtatcccttgcaagagtgagcatgcatctaaagacatacagaggtgataaaataaatgtttagaatagttccagagaatgaagaatctccttaggaggtaaagagttgaatgacataattaacttggggttgggaggaaagatatttcttcatattttgcctttaaaacaaggttagtgaaaatatatttgtaacttttaataaaatttcccaaatgttgccaagaatctacccagatctttcctcttttaaaaacttgatatttgtccaaatgtgattaattcgataacttatcctccccacatttacaaagggaaaattcacagctgttactaattacaagtctacacaccataaagtaattaaataaaaatccaagtttactagaaggctaaatttagattgactggcttgaattaacaaactttttttgtaaactcatttttttaaagtgaattgccttacttaactaatttggaatatatttttaaaataattgatggagagatttagagaacagagaaaaaggtagctgtaatattatgaatttctgataggaaaaataaatgaaagtcaaatatctaaaattccaacaaccaatggactcctcttcttgaagtattacaatgtcaaagtggttgttgccttcatcttctgtagattgacaggagcagccctacttagaacactcttagttaatttatactatcctcaaagctaccgtgagagaggttttattgcacacctactttaaaggtaagaattcttgaactgttaattaccatattaggtttcatatagtcaataagtactattgccaaaatttagaaaaaggtgtttctaattccagattctgtgcttcttcctcaggtggacttcacctttagatatccccatttgtcttcacggtcctttgatatactcctcagggccgctgtgtgtgaccatattggatttacactgcacaagtggtgggtgtgttatacatagacaacaatgtgactgctttctagagttacctagtgcaactgctcctgctcttactatgacatttctagtccttcttatttgctatcttagccatatttttggagattacgtcagcacccgcaaagccttttccctcacagacataatatctactcattgaaatgcactttcttccaggtgagaaatttataaatgttattatcaacttctgacattatgccttgcatatataaaggactaaaatatttggtcaataagtaaataaatgtttaaattctacaaaactagcctccaggtattgtttcatttatttatgaacatatgaatgtatacatgcatgtatttgtatatgtatggatggattatgtatggggacttaaagtgagcatgtggtcactgtatatctcattgttttatggaaaagtgccagttacaaataacggaccaataaataactgtttaaatcaggtctgttcttgaactgggaggttaaagaattctaggaatatattgtacagtaaattatgattcatttgaaaaagaatttgagtattcaaggcaaagcaaatgctgggtggaagaagttccaagaacataaaatttaacacagcattaagatatttgtaagtgagacttgtccggaaattgtatgggtttcttgaaaggaatctactccaggggcatggagatagagatgagagatcacctttctggtgtctgtctaaaaaattcttcagccgggcgcggtggctcacgcctgtaatcccagcactttgggaggccaaggcaggcggatcagaaggtcaggagattgagaccatcctggctaacacggtgaaaacccatctctactaaaaatacaaaaaaaaaaaaaaaaaaaaaattagctgggtgcggtggcggacacctgtaatcccagctattcgggaggctgaggcaagagaatgacgtgaacccgggaggtggggcttgtagtgagctgagatcgcgccactgcaccccagcctgggtgacagagcgagactccgtctcaaaaaaaaaaaaaaattcttatagactggggatattaggcctttgttggaagcgtagtttgcaaatgttttctctcattccgtagattgtctgtttactctgttaatactttcttgggctctaaagaaactgtttagtggaaggctgattattcggtactatgctcaccgccttggtgatgggatcattcatacaccaagccggagcaacacagtttcctcatgtaacaaacctgcacacatactccctgaacctaaaataaaagcggaaaaaataattaaaataatttattccacaataacaacaacaaaatcttgctatagcaatgggttggcagattaaatatactacgctttcactccagttggaaagttttgtcattctgtgaatccctatgtttttcatgaatatcacgtcaggttgtatattctttaagttatttattagcgagagttttggagaaatctcatattttacaagtaatctttgaccatatgagtttctaaaaatgaaaaaaattcttattatatactttgttataataatttttgtttccttttattaacattcagttttgttcctttgcttgagaataattccaaatgaaccaataatagatctttcaatttctctgtaattaacactgtctatttttccagaggtctactggaatattattagattctctagtggtgagatatcctgccatttttaaactttgtagataggacttctgccacttagataaccatatgggaatgaatatatattgtaaccccttggtatcattttactatcataactctcattctttgaaaggcagtgaagcaaagatccgagatatagggtagaactgtacaattggcttttcaatgttctgggaagaaagcaatgtaattaaattcttgccagttcatgttgagtcaaaaggcaaaatctagaaagctatagttttccatttcttttaaatattcttgattttaaatcctttgacccttgaagctaggcattctctcttctttcgtttctttaatagtttagtttcttcaatggcaaggcaatgttaagtgcaagctgcaaaactcagagaaaattggtaattgctacatattaatagtcaggctagcttggggttttatggttagtcagctggtaattagctaagacatttgtattagtctcttctcacgctgctatgaagaaatacctgagtctggggaatttataaaggaaagaggtttaattgactcacagttttacatgtctggggaggcctcagggaacttacaatcgtggcaaaaggcatatctttacagagtggcaggagagagaaagagaaccaagccaaggcggaagccccttataaaaaccatcagatattgtgagatcttactcactagcaggagaccagcatgagggaaactgcccccgtgattcgattacctcccacgggggtccctcccaccacacctggaaattatgggaactacaattcaagatgagatttggggcggggggaccaggaaaactatatcaagatttttgttttctttatatgaatgttgaagtttgaatgaatgtcaaactccaatattgtacgtagggtttagtaatgatattcagatttaaaactttcaatccaatagcattaacaaaaggtaatgtaactgtttagatatatatttgatatatcttttattttgtacaaattatatatataatatataatacatacataactaatctgactattctgtaaacttgcgcttagcaaaaaataaactactataaggtagtatggatgtaatttttcaatattgtcggaatatatcagtgagattaaatagtaaatttccactaacatggtattttaggaaaacaattagctgctgtgtatcaaaaatgcttcttttaagtaacatttgccttttctatgggtatacatgagtatctgaggagtatattttaatcttgatttgcatttaattaaaccaaaatgtaaagaaaataattgtttgttatttaattaaattatcagttaattacctgaacctacatacttggatattttcttgactcaaattagtattttgcaattgactgaactgccttttatctatgttttatctcatttctgtctcttggagtttcactagcttcctccaccaagatagaagactaaatttttcagatatgtgaacatatttaattttaatagattaagtcaatttagaagtctacataataagtttcaaagttcattgtagttagctgtgtatttcagaatagagctctatttgtctgcaatggctgtgggcaacttgtaagtccataaatgaagactgtggacaaaatcacccattgcagctatcaccaaacttgaatgacagcccctggagaactgagctgaagtataaatgagtgacaagtgctgattttcctagaatacagaggtacaaatgacctagatgagaacccgtttcctaaactgaagctgctttccaagtgggaggttgctacaggtgcggttttctgaaccaactgccaagaaagaaaggaatccaaaagaaattttaaaatgattctctcaagaaacatgctaaagaacaccactttgtaagaacaaccttaaatagtctctgttatcaagctaaaatagtcatcactccctaatatatcactccataattgtcctggtctgtgaatttcttctaaggtttaaagatacatccaatggtccccaaattttattgcagcttatcccaggtatacatttttattttgaaggataatttgttgtgattggagttgataatcctgctgaaatctctatttgtaggggcttagaatccattccttagtgttatgtcttattttagacatttttgaatcatcttttggtcttccacatttagtaaattacaagctttcaaggatagggaatatgacatttattttaatatctcccaagactgtgaaaattactgtcatatttaaaaattcaaactctcaggtaaataatgacacattgtcagaaccccttgctgtgattttttgaaacatggcttagttccatgattgagattgaatttaaaggaggaaaaaaggtcacagaaatgagaagcagagatcctaaaagcaactcattaatttgttcttctaggcataggacccctttgtccttaaatatattttccctgtgtcacacacaaaaagaagaatgtacaggacaaaatgaacacaaaatatgtgaacacatgcttaaccagcttgctcactcttttcttgttctttttttaccccaacatcaatttggatgtgggtattatcacctactagccttctattctgtctttctcttttcctccttctccttctaactctttcactctatccatctttccccctcctttctacatattatctctaagcctacttattcagaaatgacactaactcttttaatcaatccatctttcctcctcctttcaacatattgtctctaagcctaattattcagaaatttcttctaaaaattttctgtttatgatttccaaagtatcattttctaatgtttactgcaatattattggaacaggaagcttgttttgaaatcttgtaaattgccttataaacacttatactatagtaacttatactgtaataagtattctatttctggatattttaataattgtttttaattgttaaataatacttccaaatatgttatgtaaaaatgttgtgtaggttacaaatcacatagacacatatttttcttttagtactatatgttcatgtttgcagtttttgaatatgattcttagtgaaataaagaaaaagactacttaggaaaaagtatcaaattttggattataagaattaataaattatagtggttgttaaataactatcgatgtctgatacaatttattatttttattgtggtgtgtaatagaacaaaagcatattaacattaaataaaaatgtagtcacacaaaacatatgtttaaacaaataaaggaaatcagtgacaaaagagagttgcaaaacaaaactaattttattttataaattattaagggaaaatatcgtaaaataaatagctatgtgaagagagataaactaggtgacctgatagaggcctctttaaatcaacaaattctcagattcactgggaaactatccatcaaaaacacaggctcaggtggctttaatacatttctgctcaagaaattgaaagtaatgaagaagagtgtgtactcaaatgacaaagatggagaggagttctgtagagaggttttctttccaaatgatgaggcaaaggaaagggtgacactgatgacgaaggacttttaaaaaataggtcatagagcctacataaaagaacagaattttagcttttacttttgattccttaaatattaactaatgattttttatggtatgcaatgttataggcttagtgtagtcattttgctcttttttattatttgagaggaaacatgaatgtaattcaataaatgcttccattgaaatatgtgcttcatatttccaagctgttttaaaatttacatgctctgtggttttgtaatacatatttcatcttatctgaaaataatttgctacaccattatgtatgtatccttactatatttccatcctcataatataattgagatcattttttcttatttttaaactataatgaccctgtaatcacctgatgagttcttcttgctcactgcccagatagagctgatttactgagacagcagaattgcaatagagaaaggctttaataaatatacagcaagctaagcaaaagacatgaatttattaatcaaatccatctccccaaaaatttggagattagggcttttttaagggtaatttggcagacatggggctagggagttagcaatgaaaagatacgaagttaaagtgagtttttgctgccttcagtccctgggtgggacggcagaactagtggagccagtttacagatgtagatggtaccagctggtccatcagactgcggggtctgaaaagtatctcaaacaccagttttaggttttacaatagtaatgttatccataggaataataagggatgttaggaatcttataaggtctggctgcatgactcctgagccataatttcaaatcttgtggctaatttgttagctttacaaaggcagtctggtcccccaaaaaggagggggtttgtttcaggaaggtgctgttactatatttatttgaaagttaaactgtaaactaaattcgtcccatagttagctcagcctatgctcaggaatgaacaaaggcagcttggaggtttaaagcaagatggagtcagttaggtcagatttatctcactgtcacaatttttgcaaagatggtttcaatctgtgttctatgcccaagaatcaaacaggaaaagatacaagaatacgtagacagtaattttgttttttagtcaatagcctggattttccttaccaaaattttcctctccgtaagtgttacaatgatgcaaattcaaaattcaagtgtccacttttacttatgggaggggaagatcgattcaagaaaagtaagaagtaaaatcttgatagatttttggtggctagagcatagcagaatacactttccttctgcttgactgccttggaacacaatggcctctaacggccatttgacaccatgaagagttgggaaaacaatgaagatttggaaaggaaaaaaagggccgaagtaaacatttatttggcaccttaaaaaaaccctgaactttaaaaattttccatttaatcaactttcacttccttctacatgttgtcattttgcaatatcgtcaaacaatttaggcttttaaaatgtagagttgggattgcaaaatgtaaaatttgaccttttttccccacatgaagttcgtaggattgctggaaacaaaaatgctagtatcctgaaatgtaaacttcacaaatatagacttcttcactttttttaaacaacacagtcatttattgtttattgttcatttcttgtgtctatacagttaagcatgttgtaggatttagatcaaatataaaaataaagttttatcaaattaaaatgttacagtaaaaatacttgattttataaagacaaaattaagcagaaaaaactgacctataaattagatgtctattttttaatctttcatagattgatgtttatattaatatgaattcatatttattagtatatcagctggattacaataacattaaaatattgtgactaataatatttatggggatgattaaaggtctttaaaagattattatccttaatagatgacagaaagttttgtaaatattttatatgtaatcctaacagcattaatataaattatatataattatttttccattgtatatatgaggtattagaaatttagtaaagttaaataacttgtccaaattcagatgaaaaggatgctatgtagctgggatctgaagacatacttatgtacctaataattacaacatttcatttcatgttatgttatattctattatgctggttatgctatgctgcacattttattatacgataatgaaactttatataacttctggaatacaaaaaactgacatgtgcatgttcaaatccttaattatattgtatgaatttgaacgaatttaagtagtttatggttttgtagagaaattcttcataactttacatttttagttgtcctccttaattcccctctagaatacattctgaccacaaaaggaattggcaaggatatcagtgtataacacatgattaagtatttgtacaaaatatttttccacagagggttcttgtaaattctggacctggggtgggtaagggagtgtgtaatcattataagaaattcaatgtaagaggtctgagattgaacaccacatgttaacagaatttgagatgttggttctatccataggtggcaggaatttggcactgagatcacctgcaggatgtggcaaacttcacactgctacattctcacaataggggttggagaaaatgtgccctagctcaggcagatagcaaagatgctctttaaaaaaatctttgaattttacaggtatatactaattatatatatgggatacatgagatattttgatacaggcatacaatgtgtaataatcacatcaggataaatggggtttccatcacctcaagcattcatcatttccttgtgttaatgaacattccaactgtactcccccagtaattctaaaatgtacaataaactattgctgaatgcagtcactctgttgttctgtcaaatctagatcttattcattgtatctgactatatttttctacccattattcatccccattctccatcccctacttcactacccttctcaatctctggtaaccatcatttagctctctatctccatgagttcaattgttctaattttattaacatattatttcattatttcctttctgttattctattatgatcagagaagagacttgatatgattttaatgtttttgaattttgttttgttttgtttttgagacagagtctcgctctgtcgccaggctggagtgcagtggtgcgatctcgactcactgtaacctctgcctcccgggttcaagcgattctcctgcctcagcctcccaagtagctgggactacaggcacgtgccaccatgcccagctaatttttatgcttttagtagagacagggtttcatcatgttggccagaatggtcttgatttctttacctcgtgatcttcctgcctcagcctcccaagtgctataatcccaagtgccgggattacaggtgtcagccgtgccaggcctgaatgttttaagacttgtttgtggcctaacatacgagttatccttgagaataatccatgtgctgagaagagggatacatatcctcaatctgttgaatgaaatgttctgtaaatatctattaggaccatttggtctatagtgcagattaggtccaaagtgtcgctgttgattttctgtctggatgatctgctcagtactgcaagttggatgttgtagtttcaactattttcctattggagtttatctctctagctctaattatattatttatctaggtgctcctgtactgggcatatatatatatatatatgtgtatatatatatatatatatatatatatgtgtatatatatatatatatatatatatacattgttacatcctcttgctgagttgtttatcattacataataaacttctttgtctctttttatagcttttgtcttgagtctattttatctgatacaagtatagctatttctgctcttttctggtttcatttgcatgaaatatctttttccatccctttatttacagtctatgtgtgtctttattggtgaagtgtgtttcttgtaggcaacatattattgggtcttgttttttaaatctatttagccaatctacgtattttaactggagagtttagactatttaaattcaatgttattattaataagtacagacttaatcctgccattttgttatttgttctctggtagttttttggtcctccctccctccctccctcccttcctcccttccttcctcccttccttccttctttcctttctttctatcttctcatatgtgaaaataattttattgggtattacattttaatttcttcctttttattttttgtgtttctgttgtaggtattttgatttaaggtttccaaaggcttaccaacatcattttataacctgttattttaaactggcaacaagtatgattgcaaaagcaaattaataaatgagcaaagagaaaactaataaaaactctttactttgtctgcatcccctaacttattagctttttgctgtttcttttcatgtcttattaaattgtctatgtcttgaaaagttgttgtagttattatttttgataggtttttcttttagcctttcaagatatgagtaaacacaccacgattacagttttataatattctgtatttgtctgtaaacttactcttaccagttaattttgtaacttcagatgatttatttttttttaacttttaactatcagttctagggtacatgtgcacagcatgcaggtttgttatatatacatatacctgtaccgtattggtttgctgcacccattaactcgtcatttacattaggtatttctcctaatgctattccctcccccatccccttacaccacaacaggccctggtgtgtgatgttccctgccctgtgtccatgtgttctcattgttcaattcccacctttgagtgataacatgtggtgtttggttttctgtccttgtgacagtttgttcagaatgatggtttccagcttcatccatgtccctacaaaggacatgaagtcatcctttttaatgactgcatagtattccatggtgtatatgtcagatgacttcttattgctcattgacatccttttctttcagattaaagaactacgtttaggatttcttgtatgataggtctggtgttgaaaaaatccctcagcttttgtttttctgggaaagtctttatttctccttcacctctgaagtatattttcactaagtattggatttcaaaataaaaaagtgtttttccttcagcactttaaatatcataccactctttcctgacctataaggtttccactgagaaatctgctgcaagatatatcacagctccttcataggttattctttcttttctcttgctgcctttaggatcctttatttatcagtgaactttagaagtttgattactaaatgtcttcagtagtctcatttgggttaaatgtgcttggtgttctataaacatcttgtacttgaatattaatgtctttctctaggtttggaaaattctctattattatttatttgaacaaatttcctactcctaactctctttctatctcctctttagggccaatgactcttagatttgctctttggaggatattttctagatcttgaagacgtgcttcatttctgttaattcttttttgactgttctgttatttcaatcagcctgtctttgaactcacaaattccttcttctgcttgatcaattctgctattgagagactgatgcattcttcagtttgtcattgcacttttcagtgccaacatttctgcttgatcccttttaattatttcaatctctttgttaaacttacctgacaggattctgaattccttctctgtgttatcttggattttatcgagtttccctaaaacaactattttgaattatccatctgaaaggtcacacatctctgtcactcctgaactggtcactggtgccttatttagttcatttggtgacatggtgtcttcctggatggtgtggatgcttgcagatgttcattgatgtctcagaattgaagagtgaggcattcattctcatatcacagtctggccttgtctatactcattgttcttgaaaatgcttttcacatattcaaagggagttaagtgttgtaatctaactctttggtcactgcagccatatgtacattaagggggcaccccaagcccagtaatactgtgactcttgcagatctgtagaggtaccaccttggtagtcttgagtaagttctggaagaattccctgtgttactaggcagagtttctttttattttctcttactttgcccagacaaatggagtctttctgtgtgttgagttgcctggagttaggggaaggataatggaaacactcccatggccaccactgctgggactgtgctcggtcacacttgaagccagaacgatgttgggtctttcccaaggcctgtggtgactatttcctggctattgctgatgtttattcaaggcccaagcgctctttagccagtatgtggtgagttctgcctggcctgggtctctttcttcggggcagtgggttcccttctagctcaggatgggtctggaaatgccttcaagaactaaagcctggaatcagggattttaggagtcggcttggtgctttatttttctgtggctgaaatagtaaccgagttgcaagacaaagtcctttttacccttcactctcctttccacaagcagccgtctgtccttgtggccatcacagctggaatgtgctgggtcacacctgaagccagcattttactaggccttggccagggtctgtgccaactgcgacctggctattgatgatgtttattcaaggtccaagggcacttgggtcagcaggtcatgaattctgccggagctgggtccttccattcgggacagtgggtttccttctatatatctagaaatgttgtctgggacacaagcatacgtatgtttactgcagcactatttacaatagcaaagtcacagaaccaaccctaacgcaatgaaagactggataaagaaaatgtggtacatatacaccatggaatattacacagccataaaaatgaatgaatcatgtactttagaaggacatgaatgaagctggaagccattatcctcagcaaactaacacaggaacagaaaaccaaacacatgttctcactcataaagggagttgaacaatgtgaacacatggacacagggaggggagcaacacacatcagcacctgttgcagggtgagaagtgaggggacagaacttagatagtgggtcaataggtgcagcagaccaccatggtacacatatacctatgtaacaaacctacatgttctgcacatgtatctcagaacttaaagtaaaatataaatgaatgaatgaatgaatgttgtctgggagatatggcctaaaatggtgctttattttactgttactcctttatgttgctgttgctgagctcgtacccaagttgcaagacaaattcctctttactcctctttttattcccagagctacaatcttcactgcctggaattggaggaggggtgacatgaccactccattggccaccccaagtagtatctcactggattgcatgtaccccaagtccactggctcagagtccagcacagcaccaagactagcccagcaattgtagccctttgcctagactgctttttaggtttatttaagactacaacgcaatttaacccacaggggtggggctagccagaactcaggttccagctgccaggatagataattcctctctggctagggctagtccaaatgcttcctctgtgggcacaggtcgaattctgccctgtgctgctttgcactgtgacagagcagcactgagttctaatgtaaagttccacaatcactttgctgggactttacaatagaggagggatgatgtcagcaatcaagactttcttttccaccctcttcttgcctctttcctagatatgatatgtaaatcaggcttcctgatttttggttcttgagaaggtgctttcttgtgcagacagttattcaatttggtgttcctgcaatgggaataattgctggagggttctattcggccatcatactctgccactctcagcattaagatactcttttaaaaaaggatttctgtagtgagttaaaacttcagtgttcccccatcatgggtttataatataaattaatattgatgtaggaattgttgagccaaaatatcttgaagattggttataggcgggtaatatttctgaggctctcagaggcataaacatacaaagcaatgtggaatatttctttatgtgtagatttatggaaaagggagcatattggacaccaagagcatgacttgttacagacacacagtcttaataagtttgctgttgcagcaaatctcctgcaatggattcttcatttagatttaatttagtttataatttggaatctttattcaatctactctacatattgattttgaaattgccttgtgtagtacatatttttttcttaccctctcaaggtaacttaaaaaatgtgtctcagtgggttcatttaaattttctttcccctatccttctattattaaacattttccctcctttatgcagctaatagttaacagaactaattgctaaagatctgtcctctatagcagtgaatacataatacaatcctaaatttggagcaaatgttttgtctgcgttattaaaatttggggaaacactgatgatagttcttaacttgtctgtacgaaaagtcttgcaatttcacaatgccttctgatctagcaattttacaatacaatctttctttacccgaagaaagcctaaaaaaggaatagctcattagaagatcaagtaaagtggagtagaaagtgtgagagatttacaaaggttaaatttcaaaagttacaaatcttttagaaaggtttttttgaagataaaactttgttttaaggtttcagcattctaattaaaaactctaacttttgaattcttgttgttctgccctctaatttttacagattctcttttaaacagactagttaattcattttacatgtaaaaagtttctccgtaatggccattgttctgtgtcaacctagtttctggtcattaattgaggaacttgcaggtttaggattaaaatgagattttatatagaaattagactctctttaagaaggaggttgagatttgggcaaagacaagcccatgaaaaactagaaagcagtgcactacatttgatcagtgtgtgtgcttaagaatgttgttgtgggttccccaaataggaacaggcaagaaaggggtcattatgatcaacaacttgccagctgttgcagttcttttacaaatctatagaacagagaatgcgttcatgaaggttttgtaagggacctaggataaagtttgactaataccttttcatgactagtcaatggtctaatggacttccaactatgattactcagagtcagcttggattggattggagacttattaggatattgtctccatccatcctctacaaaagactccttgatatgtgttcaacaagaacagcaaggataaaaccaaagccctataacttggtgcatatagagaaacaacagcaaaaacacatcaaacagcagaagataagcattttaatagaaaacaacttgccagtggtaaactttcaaaccaaagccttagtgaatctgcatgaaaaatctaggtctaatttgtcaagtgatgcacttttcaaccaaaattaccttatacacagatccatgcttgaaatttttatataaaaatataggtttacttatatgaaaacctatttgattacaaattgtaaaataatgaaataaaatttgcaccaaaacatcaataaaactaatcagggcatggatctttattgagactgtctcacacagtggatctaaataaaaaatggtgttttgtcataatccttccaatgaacacaactgttggcctgagagcctcctggaattctgctgagtgtattccaaacaaacctggtggaagccccagaagtcctcatgagaccaattttcaataggtgaaattaaaactgttctaaatatatttcttattgtgatgatcagatatcgtctgcctgaacagggcaggctggccatcttataaaaggttttgggagtcatggaaacagggattggtggttgacaggtgttcagatgcatgttgacatctgcagaagtaggcttactgaggtgagatgctgtttggttggcactcagaagtgagtttatggaataagtctactcctaattgcttactttcattaacaacattttgacactgatgggttggcttacgaaagatttctgctgaactaagttgtcaatgattagctgaacaaggattaacagtttctggtagttacttcttaccatcaatacagaacaataaatatttttctgtgtggaaaccttttcccccgcaaaggcgtattagatgtcgtaaatgttgaatgaaattgctgcttcagcattcatttttaggcctgacataaattgtttaaaacccaggtataccctgtcaccttagacctattgaaaaattacctcccctatctgattgtttacagtgtaacaatcttgtaaacatcttgtttctcatcttactgacccacaacatgacacactcacagttcccatatatgataaaatctagaggtcaacatcagaatcatgtaaaaaaagttctcaacacagaatcatgtaaaaaagtacatgcaaattttctttaaactagacaatctgtaattctggtggaaaagtctaaggaataacacccatgaactttaagaaaggaagagtcacacaggtcctctctctcttgctttccactcactgtttaacatctggatacctccagacttcttgccagcctcctgttggcaccccaacctctctaggacctataagtaatacatttcttctgtttcatgtactttggttttactgcctcacgtgtctcacttgacatgcacaaacttgaacctgaccttctttccaggccagctctctatcttagaaagtggctgtcttggtaggaataaatgggccaagggttataggagagccccacaagcatctggtggtataaacaagattcctgtgaaaggaatatttggccatgggttggattcttccacattagggaaccttccaggattaggaagtatcgcatgaaaggcacactctatatacccatgaccaaatcccttgaattttatggtcagggcattacaagagccaatgaggctcttaagataaagacctcaagaacaaattagaaagaaacaatagcaatagaacactaagctagagtaaatccaaaagagtgatatgaaacattaagaatgctaatagaaggcccaaagttagaaattaatgagctttgataaatattaagaaatatgtttcattttatttataagcatttgtttagagaaattttctggttgattaaatttttaaataaataatacaaatttcatattttaatgttttaattactgaatgccaatatggatttattttactaataaatcttgtgaaagatttcttctttcatcttgaaataatgactttattatgtttattaaagagaagtacaataattatttaaaatcatcaaacagcactacaaagaaggggaaaaaattcaaggatccgtaaatctcaaataatcatccttagtgttaaaaccattccctatgctaatccataaatcccacaaatgttagttttagttgtacttaattgcattcagtgtttaccatttatccctttaacattatacttgttctagagttatattttgggctacaatttgtaggcttattttatcgtgttctttgaaattcacacatttaaagttgtttgcttgttgcttctaaacttgatcaccatattctctgagtataatatcctctggcttcacttatcctgcaggatataatatactttaaaaatatttattctgccttttaatgtttctcaggagaagtgtgaagccaccttgagttttattctttcattatctcattttcttctgcaagaatgactgaagagatgttcatttttctcaaagttcaataaatgaaccagaaacctacgtggcctatactcagatctgctgagtctacttgattttaatactattagaatatcttactacattctagaggctagaaagctaaagattgttttttttcaaagtcctctttttcatcttgacagatgcatctgtataggagttttgggaaaggtacataatatcaagaagaattgtcatacgggctacttttcctttgtttaaaggctttgtagtaacctcaccttaggtagttaccctgctctcttatatcaaatatcctagtaacccaaccctactaaattttattatctttgctccttacatgtagtggagggtagtgatacttaaggtataggtgtaactgacatgataaagagacccaaaataaaatgaaaatgtagttctccatcacataaagtgaaaacatgagtgatctttgctggtgtggtttttaaagaaaatccctattattttattactctacaaaattctgtgaactatgtctcatgtgatatggtaggtccatatctaggatcctgcttcaggaaattataaggtcatagaactgggaggcaaacaatttctttaagcaaatgacacaggatttacacctgttatttctgatcatattcggttgttaagaacttggtcacatgtcatttgcttcctgaatcccctgtatagaaaaaagggtaagccaagatactatgttgtaatatgcatcaccaaaataacagtggcttaaaatgagaaccactagcaatataggtcttgtttctactatagatgtcatggtttaacatgggggcaatttgctcattattgacattcttgacgtttgctcattatagacactcatgaatccacactagtagagcattcatgatctccaatattgcctcttgcagtaatgcaagttatggagattactgtatgtgaacagcagaggtcatttctgttcataaatacttataatattttgattttagtctcccaaactgcttgtggagagtgatgagaagttagaatgtttcttttattcatcaacacttttcaatgcttatcaaatgaaattgtgctacttttattatttgactcctgctactgtgtgtgtgtgtgagcgtgtgtgcatgcatgtgaatatgtgtttgttttactatttttttttgttttgtgtaaggtattaggataaagagactctgtaatacagtttcactctaccatttttacccagaaatattttatcttcaaaatgtattccatagcatatactccattttaatcaacaaataaagtgttgttatgggctttccaagtttttgctactctaaataacactacaaaaatacccttatgtcaatttccaattatttttaaacattaattttttcaaatctaattgcacattttcaggttatttgagaatatgaccatgttatagacagattgtatatatacaacaaaaccaatatgaatgcaatttcacttatcactatcactggctactttgttcttttttgcttttaattattttcttaaaactttaaccaatatgaagaactgacattcatttgctactgaatttaactattttaatgtctattgtacatttttcttcatactggtgaattgcctattcatgtcctttgctaataaaaaattaccttattaattaaactactatttacaaaccatagaataaccggtggtgatcgaagatttttattaatatgttgtttatattttaatttttaaaataatctttaagtataaatttaatatttggtagaaaatcttataagattttagttttggggatttgcctttcttttcacacttttgtgttcatatttgaataaatatcattcatcatcctaaattataacagtattacaaaatgattttttctaattatttttcccagatactaatttttatttaatgtaagccagtatcttttttaaaaaactattttatttttaagttccatggaacatgtgcaggtcgtgcatatttgttacataggtgagtgtgtgccatggggatttgctgcacctaacaacccatcacctacatattaagcccagcatgcattagctttcccttaatgttctcctccccaccatcctctcccaagagttcccagtgaatgtcgttcccctttaaactcagttaatacttgaaatgtacatcatttacatctttacttaacatcataaacaattctcttcttgacatgaaattcagtgccactcattcaataatccttactttattttttgattgtgatgctatagttatatttaaaaattcttaatacttattaatatttaattatctttcaatcatatagctatattactgatgtaattcttagtaatttgagtgccaactacttttcatttactttatgctgcttcttaggttcataatagggcatacatttttaagctggttttgctatatgactataattttatagaattaaaaattataggtatttttattgagaatacatcagttatttaatttgaaattaatatatatttgagtgatattgaattttgaaatttttattgttccttaataaagatctgtggtctttttaaataaatattgtacctgattttttcaaagtttttcacattatattgatctttgctaatgttaatgcttcttttataaaaaatatgctaactgtgaattattgatttctgcctattgatttgtatacagaaatcttactaagtgatcttgatgatttttgtagcttaatagatgatttatttgtgttttacaggtaaataatgttgtcatctgaaaataataaatattttgtttcttcctcttagttatcatatcattttattacttttggcaaaaatatgcaaaatgatgcaaatttaaataagttgagacactatttccctgactttaatgatataatgtacttagtgttacagtcttcagtgggattttggctgtatgttttatataaatattataaagttaaggaattaactttctataatattttttccaaaatgctaatggatattaaaaaattgtaatgacctcttcaatatttgtaagcatgagacctagtttattcttctttgtcctgttaatggtgttaattaaattaatagatttcttaatgttgaatgatccttacatctctggaaaagtcccaacttattcattatatcttctattactttttaaaatactatgacagatttcattttgaaatattcaatttaatatctttcacacatatgcacaaataaaattagtctttaattagcttttgaaagctatctttgaaggatttggtgattatttcaaatgggtaaatgattggaagtatttcatcccttattaattttgaaattgtttaaagagctagacaatcatgggtcttttgatatattgacatatcttatctataaaaccatctaggcataatacaattattataggtagctcttgagcaattttccccaaaatatttctgagagtttattagattgactcttttctctgttcatttttcaatcattctcccaataatggagatagtttttgctttattaaatctcctcactttctgttagcttgtcttactcaagaatttaaaactttaactcagaagggcagttgatatagatttataactcaagttcaatgagccagtaacctggtatatggcaagggaagccaatggatcatggttagtctatagaaacctgctcaacatggtttcttctcattatgaagagaagaaacgtgaagaagtgagtccaatctggcctgacaactacatcccagaaaaggttctgtcctgtactattattatgccttcctaaagtccgcaatcttatgaatgtaaggtcttctaggatatctgcacaaataatgcttattcaaatgagcagtcagagtcaggaataatgacctcctaacttttccttatcttacatttatctcagcttctctcctgcagaatgatgtgattctgacaggacctgtttccctgacattgtgcagtctctttcagtaagtagaatttccaagtcaggaaatgaaaacttcttatctagtatcacctattttaaattcagaaaaaattgattcaagcatctgaaaggtgtatggcatatgactttaatttccaatgctggtacagctgtttgctatttttatagttgtatggttattacaattgctagtttgaattagtgaattcaaatgcttactgacaaatttattgcagtgaatactggaaagcctagtacaaaagagatgttaaagatactagtaggttcaaaacagagttacagttttaaaaagtctgtgagctcatacataacgtgaaaaaaaaggaaggatttaagtctgctttaaaaagttaaaatgttaaatattcatatatctgaaagtttttttcttaaaaaattaacggtagaaaaaccacaggaagaaaggaataaaaaggtagattcggttttgattaaaaatatttctgataatcatacctaataagtcggcttcatcgttaatgtactgatttcttctttactaaaacatttctagtagaaattgatgaccacctgccacaggtaaaattcctgtatgaggaagtattcccaatgtctcctcactaatttttttttttgttcaggtttcacatttcaggttctacagtgttacagacaaaaatgttttctttgttgttaatactgagactcgagatttattatttgcctttactctgttttatttgcacagagacaggttaaaattgtatattctattttgtttctacatttatatgattttatgtcatgtctcatcattttaaagattattttttcttatattttgcacctgaaagtctgaagcttggtttctggtagataggaaattacagtatgtggtgaataagatgaacctctttttccagattggaaaagcagatctatgtaaaaccaaaagctgaatagtgacctttagtcttctatcaaattttggactattgatttttcaaatcagaggcattttggttcatttgttattcatccaccccatattaaccaaacatacaccatgtggcaggattgtctctgttggggatacagcagtgagcaaaacgatgtaaaatctcttctctcatgagcttctattctaatttgggaggtggagactgacaataaacatacagacaaaccaagataacatatatgtggtggagataaaggtttaaatgtatgtcagagaaggagaattattggtcataccttttttaggaagcattctctgaaaagctaaaattcaagcctttaatgactgagtgaaagaagcaagtatgaggatgcccacagtaggagcatttcaggcaaagagaacatggtgaaattcctgaagctacagtatctggggtattcaagtgacagaggacaacaaacaagaggaatgtgaaaggagatcagagagagaatgggggacagatactttaggcactgtgataagctctgataagaactttacactttattgagtgagataagaaatttttttatatctgcagtgaggatgcaatacccagccttgttagattgactttaacttcgtgttacataatttagaacatactacataagggcaagtgctgactcagaaaatcatctcaggataagagcacaataatccaggtcagagacgatggagatttggactagggtgctaacagtggaggaagaggagaaaagaaagggaatgagacagccatctacaggaatggaagaaataattttctaagaaatgtattactatgcaaagcagttgtaccacacacctgcggtttgtctttgagaacagagtaaaaacaggcaagctgcattcttccccggtccatcattatataagcagaattctggatttttgaacataggtgagtttttttccagggagatcagtgatgaggggaaagagatgaaagggattgatgaattgttcaaggaatcatggaaactgagaatctatgtcacatccaattattcttcactttctcgaagaggatttacagcacttcaaataactatacctattattttcacttctgcttggagccaagcactagaaattaataaaatatgtgggcatttcactacagaaataaattatgaaatataaagtttgctacataacattctctagaaaacatacatcaaataaaatcaatacacattgtatagttttgtttttaaaattgattcaaagaacactagttattttaatgatactatgcatgagtaggttttgtatatgattaaaacttcatgtggcatttgaagatatatgaattagtgtagatacaagtgattcttctaaaggaatctatcattcaagcctcagaattggtgaccacgttgtgctaaagtctctgatattccctgtgcttttcgttagaacacatcaaacttggcaaatatttatttaattcataacttgatgcatgtccactttttcttacattttaaaggtaatactcatgggctttcttatatcatccttgcttcaccaatacctagaatattttctgctatttagtattaatataatcattgtttgttgaatacatgaacatattaattaatgaaaaaattgtagaccattttggataaagaataagaagatctggttttacctctagctcatataaaaccaaatgtatgagccttcgaagttgatttcaccatgaatatttaaccatgaattccttttattgtcaatgatgtggaacagatgatcattaaatgccacacagattaagtttgtgacagcagctacatttggaaaaacccatctttgggttggtaaaaacctggactttgcaggtatagctcaggggtagagcatttgactgcagaaacttggtcttagagaaactttgaaaattaagtcctaacccagtaaaaagaaatgtctaataaatctaattatcctttttcaaaaatgtggaaactctggggagagagaaaagttaatgggtaactgggtaatcagagcaaaatattttcttatcttttaaggcagtctacagaaagacctgtaattctaaaaggactccacccaggcagtggcacaaccatgactcaatgggttcaaatgattctctcacctcagtttcctgagtagctgggagtacaggtatgcaccaaatgcctggctaatttttttttaattttaatttttattttctgcagagacagggtctggctatgttgtacagcttggcatccttgccttaagcaatccgtcctccacaactcctcaaagtgctgggcttacaggcatcagccaccatacctggcctaaggaattcttcatggtccatttgctaggaattaggcatatttgaaatagtgttgatatacaggtgcaatatcattatttcaccctaatatttctttgcagaatagtcttgagttataattagttgaggataatctgaatttaaacgtagtaatcagtcagtaggaacaagatggctcttgggattttgttcctaagcacatgtttcttttttatcattttaacatttataaaaatctaaatcacagtgttttacataataattatatattaataatggaatttattatatatggaatatatatgacatgacaatgcccatacacacagagataatgtcctttatcccatccactatttatcctagtcatttcaactagcactgatggctaatcactgtattcatccaactcatgtggatattctcattcagaaatacattcttaaatgtaggaatgcaccatttgaattcaaactctttttttgtgactttggatttcatagctataaatgtttgatagatttcattgatgaaatacagaaacaatttctctcctgactgccatgaacaatactagaaagctaatgagctcagagtacaaaattgtaaatatttccatatatttatcattacattgttttttaactaaaatttttaaatttatacattttttatctattgatattattttttattttatttataaaataccatgcgtgtcttgcaaagcaaacaatattacacatgctgcaagcaactttggaaactttagtgagaagaagcaaagcaagctgtcagacacttcagtaattgaatctctttgagaactgtcttggtttgtcagcactgactttcctgtcaaaagaaaataaaataacttggaaattcatctgagataactccaggggtattctgataatgccaaggcaagaacactaagtgctttctcagaagctgtttgtactaggataccctcttcctagtatgtataagttcattttagccttgagtttacattatctgatgttgaggtctgagatttaataatgacctgtcaaatggcagtacataagccttccttctgctattaggatgcacaccatcattgcttaaattgcctagtataccctttgtcaattactttgtaagtgctatccatcttttactgcttccgcacttggattgcttgtaaaatgtttagtggttaattatcctggaaggaagtccaacttatgaaaaaccaggtagaagaaaaaaatgtcataaaattaatgacttattctccagttcttatctgataaagcaatgttaatcagatccctttggaaatttacccttgactaccattcagcgctctctataatcagcttcagaaattttccactctggcttctcccctttggcccatgcttttctccaaaggacttgaatgtattaagaagagattgacagctctcctaacaactgcagactgtgctaacaccagaaggaaataaaggtcttgaaacttctctgtactgagatcagaaatatcaaacatgaacatttatccataaatgaaaccaatgctctaatatgcatgggctgaccttgagttcccattaatcagttagaggaaaagttatagaaaacgtacaaaactacatacttagaggtataataaaacaatttttatacttttgaagatatcacactgaagaatgtcaatataaagtgccatgctggcatagaaatgactcatttattgttcagttttacttttacatctaacaaaaggattaaaaaatccttaaattagcaaaaatatatttttattttaaaagggactttttatgatgtgtacattgttgaaatcaaggtatataatatttgttcacttaaatatcgacatttagaaatatatttagacaaaaatatagacctttagacattttaagtatagatatttagatagtccttcatgccttcttttacatgagaatgattatatgaaggccatataactaaatccagtttatataaatgttttccagattgtgggtttttaaataccgtttatggctgttcataccaggtaactggagttgagaaaggccttttcctgctgtggcaggtattgtacagctcttatcataatttcagccacctcagtctaccaaggatatgcgttattttgtttacaaccaaaaattatgaggttgtgctccaggacagcagtccccaacctttttggcaccagggccggttttgtagaagagaatttttccatggacccatgggatggggggcagggatggtttcaggataattcaagcaaattacatttatcatgtacttttttctattattaaaacatgtaatatttaatgaaataattatacaaatcaccataaggtagaatcagtgggaggcctgagcttgctttcctgcaactagatagtcccacctgggggtgatgggagacagtcataaatcatcaggcattagactctcataaggagcatgcaacctagatccctcacatgcacagttcacaataggttccctctccaatgagaacctaatgctgctgctgatctcacaggaggctgacctcaggtggtaatgcaaacaatggggagtggctgtaaatacagatgaggcttcactcattcaccggctgctcacctcctgctattctgcccagttcctaacaggccgtgaactggtactggtccgtggcccgaagcttggggacccctgttctaggggactcacataatgcagcacaggcttcttcttaggctcatcagaggtcatactttttcagattctactgaaaaaaatattaaggtagaaacttcctttttttaagttggtagaatttcatattaaattatttaatcttattcccctactcacactaagaaaatattattcaactgaaataaacacaatgggtttgtaaattcatttaattgttctttatcctgtggatacatctcctcatatcttaggccacgttctactttgttcatgtcacctagccatcagctatctcaaattttgtatagtgataacatgttggacaatacattactatcatttagtccatcagtgcgaagtaagtttcaagtttcatcaaattccaagtagtatattgctctcagtattcatcaaactttaaatttgatgttttatataacaacaggataaatttctggtaagattaatactcttaatttaaagagaaggcatttctgattaaggtactgttttgtatcagaagaaataatagttgactattaaggcatatatatgctttataggtctacagtaaattttaaaattaagtagttaagtgtagcacattattaatttggatttcaaattgaaatttaaagtacactttggctgttttacatagtagtatgagttttaaaagtcaaggtaattattttgaaaaacatcaatactttatgtgtgtataacagcaataaaataatgctatcattttctgattatgaccagaaatctttgtgttaaataattttcaattaattaaaaagtaaaacccacctgtgatgtcattcatagagatatttcagtgcatcctcatataaatttatgttctatagaatacaaagaaattctactttccacatagttttggattctttttattgttcaaattttaagagaaatagaagtttaaaaacttgttatttgactctttgatgttggtcaaagtagaattctttggagaattaaaagtgcagcagtgcagtttggatacatctccaagaatcaggaaagttctgtgtctaaatgctgagtctgtttctttgactattttaggatattccccagtaaagagctcagctgagtcttctgaagtttgttgagaatgcgctcccctacatgagggaccttactgccaaactaaagagcctcagccttcaggttgttttgaactttggctctctacctggtatctattcaggttcttcaaagagagacctcacgcagggatcccccaggctgaggatgtagttgcagaaaccaccggagttgtttatagtacctttaactcagagagcattgcttgttcctctgggcttaacccttggatttatgccatttgccgctgaagtcttatcattttatcaatttttagcattattatgcttgattatttgatctcatttataagtattgaaaaagaagtgcttagctcttagaatgacgggcgggaagcagaatcacttggcttttccaacggcgcatatttattttcttcttcttccttcatcctaggtacactctttacagtaaaatcagcctcgatataatactagcgatctggtaaggaatatggtgcagtgtgactaaaaatctttccctgaaaattaacaaggggtcaaagaggcaagggggcagaagtaaaagaatagacattttaacgaaaatcaacaagaggtcaagaagacaagggggcagaagtaaaggaagagacattttaaacatttcaagagaagggacattttaaacaccttatgtacatgagcacacaactttctgcaagagtgttatgtgggcagtatcaggagtctcctttaacagatggtaaaaatgaagcttacaagttatctgtggtcacagtgctagccaatgataaagccaggattaaagtccaagtttcatctgacattaatagtatcacttttagccactggaacagttatcttcttacccgtgaacagtgcagtctcattatgaaaacatgtgacttctaattttgtcatgagcagtccacagcaatacaaaataaaccaatgggaaagaagtcccatcaagggaggaaaatttcattgtaaactatggcatttaactttcataaataaccaagcagttctgaatctgccatttccttcctgggaggtaaacaccagagtgtccaaaatcagtatcttcgatgccttgagtgccagcatgctgcaacagacttattttcaaaatgggtaattcagtgggttagtggaaagagatgagcctttagaaccaacttgcagtgggttttaatttcacacaagctcttattggctgtgccaagatggggaagtccacttctctgaagggatttagacatttttaaaataaaaataatatttgtatttttgcacttacaaagaataaaaatatataaagcacagaataagtattcaatgattgatatgattttcattgttattagttttatcatcacttgactttgaattaaataaatctgtgagaggtaaatcttccttactccattcacatggaattttcaaggatattgacaagattttgaattatttctgagagattatttaagaatatacatgaatatgtgtgtatatatgtgtaagtggatatatatgcactcacatatttaggcatatatacaggaacatatatgacattttatgatataattacatataaaatataagtatatatacttatatacgtatgatatatttatacattatgtaatatatatagtatatgttttaaaaacattagttgaaataaatctatagatcttcccacatgtattcaaaggaataatatgattctcccgattgtgttttgtttcagctactttcaaagaaatctttagatcataaaaaagtaaatcatcaattttccctgtactattcacctctaaacataaacaagaaactatgagagccgaaatgtagtcactccaaggatacagacaaagacagaaatgcagacctcaatattttcctgtttgatttaatgctgttttttgtaaaatttttccagggcctgaaacttaacacgattttatgcattgtctttaagtaaaaaagcacatgattacaagcaaaaaattaagggctttggatggagcatgtgcccttagagtttatacattatcagctttatttaaaagctatctcagcctccagagtctaccacataaaaaattattgcccaaagatagaatctgtctagtccccgcttttgttaactgataaatactacctacaatggctttttgtcccaaatttggtctctattatctaactccaattccagtctgcccatcatattgttatactatgcatctcctttactcaaccttgagtctctccctcttcaagtgattatccatagaaagttcctaacctttatcaccaaaataataatcaaactagctatgcttcattatgctagactagctccatacaatactttagtggtgctctatccgcctaacaattgacagttattttcaaataaggtgtcttatacagggcaaacctttggtcattgtaatactatattactatattaattaattgtaataatatattagtatattaattaatatatttaacaaatcaagaagtttttagaaaacaagaaagaagcatgtatacacatagagggaacataggaaagtcaaggcaacaagtgtttctatagattctgtattgttggcatttaaattataagcaggtaatccgggtttcagaccaggtcattatctgagtcattaagtgctttgtgtgccaggctaaaggccttagacctttgcctgatgactggagcaaatttatcaaaggatttgccttggtgagtgccagtaaataatctgtcttcaaaagatctctgatggcaagaagcagcatagaccgaaaagaagtgaagtgaagaaacaggatgaccactttagggtcactataactgaaggtccaatgaggattgtatgagtgatgaaagtgagaagaaaaatcatcaacatactctcaaaagataaatttgatggagcttgggtagtgattagaagtggagaatgacagagtgaaggaaatttagaaaccaaactatatttattatgtttctgtcttgaggatctaagtggatgatagttccaacaaataacatggaacttgaggaaaaatgcaatattgtaggtagatgaaaaatttagtgatatccatgttgatgttcttgaatgattgagatatttgtctgcaatattaatctcagttaagcacatttgaaagtgatctaaaactgattcagataattctagctttctgacccctagtactctgtgtgtggaaaattaattctactttccaatctctattgtaaaatgtgtgaatactacctcaggaatccagaacccctgagttcctggctcatatccaagagtgtatagttgaagttatttttcttcatgcaaaggagaacattgatatttgagaaaggtaactcaaacacaaggactctactatctatcacctctgaaattggtgtaaattctactattatatcaagttggattatcaaaatgcttatctgactggctcaagcctctgaacaaattttcacagaaatgccttcattgcattatttttaatgttatgtccttgtcttttattaggtagagattcaataagtggacatatgaagaatgcttccagcattgttgataagttgctattgaagacactgtccattattctgttcattgccactcatctttgaacccagggaacatactaattttagaacatattattgaaaaactttgattcctttgaaaaaaaagcaggtttgatattttggtcaggacatagatagtgtagaattcaatttgtttttgcctgaattctcagacttagactataagcaaaagcaataattatatttagtctaagttaaacttagcaaaagctccaaaactatacatgcctatttcatatagtttccattattctagatttaaaaatcattttaattacctattttctttataataaaatgttttaaagtgttttgaaagtgcttaggtcattaaatcatacatgaataaattatttaaaattccatagtggtgtatttgcttagaggtaatcataccaatattttatttcaatattttccacctcaaactttaagacaatttgtggtaagtatattgaaatacgtttattcagaattctgatgttgaaagagtttttattttgtttcttgattccaagagataccattccattaggattctactttgctttcattggttttcctatagtaaaggaagaacatcttttttaaaaaaattctgtatgatgatatagatttttaaactacctaaattaacctatatataagactagtgtataatttttttcattaaattttttagactacacacgtttttgctttcatttttaacctgtatcttttaaagcttgagagatacctctcttttctttgccatattattaaaatgatttcattttgcctataaaacttagtggaattgagtgtttgtagttaagatttgttgtagtgtctcaatatatacaactcttctaaagacttcggaaagcttagtgctgggcctaatttagagaaaagtatcaagcaaaaatatgggggaggtgaaatttgccctatgacgatagcactgacaatcaaagagaaagtaattatatagaggagcttcacttatgaagacagagggcaaatgaccgtaagttttaggaagaaataaaagggatcttagaatgatgactatatctggtagggccaccataacaaaatactatctgctgggtggcttaaataaaagacatttattttctctcagttctggaggctagaagtcaaagattgaggtgctcaccggatgctttctagcaaggcctcttcctggattgtagatggccaccttctccctgtgcccttaagtgggggttggtagggaagaaagagacatctactaccccttctttttataaggtcaccagtcctattgcattagggcatcactcttatggcctgatttatccttaattacctccctaaagaccctatttctgaatacagtcacactggggttgaggacttcaagatatgaattttagggagacaacaaatgggaagaggagggaagagaataaacataacctgaggctgttgtcttgagtttcacgccacctttgtgttgtcagactcagacttcgagtcctagcacagaagactacagggagccaaagaatccaatgtggaataaattgaaaacagttaaatggtgctattttttaaaagtagaaacagcaaagtatcacaaggacaaaaaaccaaacaccacatgttctcactcatagttgagaattgaacaatgagaacacatggacgcagaaaggggaacatcacacactggggcctgttgtggggtggcgggggaggggggagggatagcattaggagatatacctactgctaaatgacgagttaatgggtgcagcacgccaacatggcacatgtatacatatgtaacaaagctgcacgttgtgcacatgtaccctagaacttaaagtataataaaaaaaaaagtagaaacaaagggaaattggcttaatgaggttcactgaacaatacacatcttcagtaaaaatgcagtacctcaattttaaaataaatctgattgacatgtttgcattcatactcactatcacaaagaatatttgtaatcaaaatgaaaatgcaagtagaaatgatgtattcaaaatttgagactcaaaacttgggaagagcaaatcatgcttatgaaaccccttgttagacttagtttgtttctcctttttcaagatagcaccattttaactgtttccagtttcttcaatgttggattcattggcacaattttcattaggatgatttatttttgtgaaaaatttaaatatttgttgattgtttcttcagagcatactaatttttaaaaaatacggccattgttaagtttctttggtgccattatttcaatcaaatatagattcatgggttaaaatgttccaagccaaattatttcttagtttgatcttctcattaatttttagtcaatagaaactgtaatgtgtgcaagcaatttcacccattcttagttttactattgatattatttgtaccaaatctagtttttttcccaagtcttaaatttgtagattgcaatgttacccaaaagaatgacaaccacataaaatttttcataattaaaacaaatgagaatatgtggctgttttactgtttatgggcaagctaaattggcaaaatttcagaaggcaatttggcttcatctatttaaagtaaaaagcgaaaataaacaccagcaatgtgatttctaggaatctctgtatagttctgatacataagttggtaaaaatgtacaggcactattatctttaatagcataaatgcagaaataaattagtatctatcaggctaagaagggaaaaatcaattggtccatttatctcctctatgctggttaaggaaagtaaaggactcgagtttttcaaaacagcttttgttcactgaaaagcatatctctgatactacattgctatgacacaggaatttatgggtgtcatgttcaccacagcagcaacaaatatttgtttaatatttagtatgcccatttatttatatgtattttctcatgagatcatcatcataatggcaactgacacatatgacacctagatgccagacagtcttcaaagcactttgcatctactgattcatttaattagctccataaagaaactgaagcatggagatattagtttaattatctaaggtcatataattggtaaatggatttaaacacaggcagtctctgagtatagacatatgctctcaactactttgctatgctgccttaaaaacatgtcacacaccacaagcattacaacagtctagtaatcaaagaaaacaaagagtaacctcaatcttcaaagactgactgaactcattgggaataggaagtgctggatatcacccttgtgatgtactgaaatgtggcagagggaatacaagtgcccaaacccttgtgactggtagattttcatgtatcttgattagtgtagcctgaagacaaaggctatacagatatgccattagtttcatgtgagtggaatgtaaaggtaaattacaaagtagatttacattgtatcattttgtgacattttctaatgattaataactatttcttgtgatctattcttctattgcaattttagatattttttaataatgaaaagaaagataattgcatataaacaagaatcttaatgctaaattatggaagtacagcatctcagtatacgtaatatggtaaaaatgaaaaacaggaaggagcatgacctatatttattcagtgttgtatacctagcacctagcacagtgttgagagaatgaaatagctgaaatcaaggacagttcattgggaaatgaggtataagacccatatattgaagaaagcaagctttctggtcatcaaaaagattttagtgatactaattccaaatgaaagtagatagatttatcagtgtcacccctggcatatagattctgggtaagaaaccaaaattattcttaagctcattgatcataagttcaaaaaaagtccatcaaagaagaattattcagaattgatggattaggactctaatgttcatttattttttcatatagttccacttttgttttaaagtcatttaaaaactatatccagtaataaacctgaaagtatttattaatctgcatgccataaatccctggaggtctatgagaaaactacaaaaatgaaattttttatcacgttgaaaaatttacatttaactatcaaacatttagataaaaatttgctaacatggacttagtttccacttcacaagaacaaaatataaaagaataacgcatattttatccttacatattgacataattttactctcagtagcatgcaaaggtattcataaaaataaaggaaaggtttttgcttttttatagactgcaatttatgatttacaacaattttaaatacattagaaattaggccaggcatggtggctcacgcctgtaatcccagcactttgggaggccgaggcaggcagatcatgaggtcaggagattgagaccatcctggctaacatggtgaaaacccgtctctactaaaaatacaaaaatcagctgggtatggtggcgagcgcctgtaatcccagctactcgggaggctgaggcaggaaaatcgcttgaatcagggaggcagagagattgcagtgagcccagattctcctataggtgatttggctcagctttgatactctgcttcttaccatcagtggactattaatgtgtgtttgggaaggcgctttagcctttgggatgtggaggaacagtgagcactctgagctttccttccccatcctcaccttatcccacgtacacagtgacggctctgtggaaaagatttggtgagtggacacagattttatttctatttggggttccaattcatcatagaaaatcccacatgcaaccacgaagcatccattaaaattatgtctggatatttcctatccaaatctatggcagatctgttctttctctcaccacccctcaatggctgagtccagccatatgccttgtttatttctggatttcaatttatgtagtttcttaacatcaacaatctctcatgatttaaaagttatggttttattgctttggcagaatattcttgatataaagtgatgatattttgggagtgtctaccttttaactaaaagcaaaaatacttgttggtaaaattttcattttctctttaatgaattctcagagcagttttgaaaaattttcttgctattaaaattggaaataattttaattattctatatacaaaatgatatgctagtatgtgtatgctagtagctgaaaatacagcaataagtcacttgcttttcttttcaaaatgactttatatattgttaaatatggtgactttaatgtcaccttttttagcgtttacccattttgctttgtggcacccatttatgtattaaacagctacaatgtgctaaatagtagttgttaattttgcacacttaattagttttgaatctttaaatcacattataggtatggactaacatttgcggaagttgctaccagatggcaatgctaactggaaaacatccgtagtagctaattatggctcttcaataccatggggtaaaaaatcattatagctccaagaaaataaacaccttttaaaaatacaacaaatcattaataaattgcctttcattagaggaatgtgaacttgaaaataccagataaacaagaattaaaatatatttatttgtacattatcctgattataaaattatttaggggaacagaaaaaaatacatgtgaatgattaagaggaataaattaattacagaagaagtcagagaaaagtaaattagacgttcaggaggttaaatcacaaaagatgtgaaatgagttactatggtctttttacatgatgagaaataattttaactctgagcttcctggtttttcagctgtgttggcatggtttatacctgtagttagagtggtagaactaacacactgcagattaggtaataatagggaaattattttaattgctggtgatttgattgtttctcataatatgtgattcttaaaattttcacttcaagccactgagtcttttgctttatcttgcattaagttccagacaactgttgtttgatcaatgactcattgattagagtattgtctgagacaagctgcattaattctttaaacactggcaactccctagagtagaaagtcattggagtgtcaactttttgacctcaggcctcaacagccaagggttgcctatccacaggagatgtatcacatgagttcttgaaacagaccataagctgtgttctttcctgcagtctttccaccctcctgatgcttccattacatctgcttgaaggcatctaaccactctcaatgacataggattaacatgagaataccaattatcacaaaaggatggtatctccatgctctcccaaaatttgaagtgattaatctgtctgcagttggcccacaggtggaaaaaaatgccatctgtctatattctaccatacactctgtcacctcagagactcaagatgtctcctcccacccctttgtggtttcacccaaagtccttcatcctctccttgcagccctcttccctgggtttcaaacttgagaacatagagttttcacatttttcatcctctatgtccactcttcacttacacatatccagaattttcacaaaaatatcctcttccaccccaaacctaaacatatcttacaaaccaattgatacaaattaatttatcaaacctttcaactcttctaggtaatcagaaacatcttgacagtaaaatttcctctaaaataacctgggatagtatgcttgccctaattctgaaagttcaaatgtcaactttccttgtggattcttgaaattgttcttaaaaatatttcttccaacctagtatagaacttatcacactctccctttcatttggaatttacactttcagatcaatctgattactgctcttatgccaacaactcctgttgttctatcagtgaggatttacttctaaggttgattctcaatacattttgagttcagttgactcggctacacaactcttaaaactacactgcttttctgttatcagaaagagctcttgtactcaattcctgttttaagcaacattcctttgtgactgattcaaaatagcttatgctatcttgtgatccaaaaagcaatgattgtaaaccaatatataaagacagatttccctataagtacattgtgctaacctagttaccttcatgtttacaggctgaacataaggcctgacatatacacctggaaaagcataatctgtttcctatttgtcattatgtgtcattctcaaacacaacatgcaaatacatagcattcctgggagctaatggaagtgagttcacgagggggtttcttgtattatttctatactttaagaaaagttaagactatcattgctttttgttgggagaagtctgtacaagaaatcactattctttattttatctcttgacaaccttaagaccttgatagcaaatcatactttttcaagttttattatggcaaaatcagctttgtttctttttccttcaaaattttaagacgataaaatgagtgtagtgctatttaggcagtgaagaaagaaacattatgttgagctgtaccctaaagacatttcttttgtattataatgctttctatccacagacgttagttgaaaattgatataatagtgtttcttgtaagtctaccagaaacaaaacaaaacaaaaaacatttaaaaagtagattagatataattgtatgtgacaaatgagcctggtagaactgtactaaaaacccatagggaataattatctatcagtggcacctgcagaggaattataagcagctgcagaatttgatttttgaacaagaaaatagagaaaattactgcaagattggtattaaacattgagaagctagacaacagaataaaatatagaacgagaagaggaagttttaaaaaggattttaatccagagataaagtgtaacacgattagaaatttttaaaaattattatggaaaaatgtacagggacaattagtggggagttatgaaaagcattcagattgaatttcacaccaaacatgtgattcatatttaggaatatgtaagtgtctaaatttagaaaatggtttgttaggcagcagggtgtaataaaaagcatatgagctctgcagacatagatgtctccattctcagctgtgtcttctacaagatgtatggcttttgaaagttactgatatatctgattatttgtttacccagtcctgtgaacaaatgaatttgcatttgttttatgccttgtagaccttgatgcatagtaggtatctagagcaagtgattttccatttccccctttttattattttggtaatttcacaaagcttcatcaagtgtgtgtgtgtattcaattctcattattcatagtacttaggtcctataaaattggcatgaaaatgaattacggaatactaaactgttgcacctatgggaaatgtagagctaggttcctgtaagcctctggtcacattttcatcaactgatcaacccaaccttgctttataattgtttctgtttaggcaccttattaatatattatcaagtcattaacattgaatccacagccagcagccctgttactcttgcccaaataaagctgtttaatacctgtattttctctgtaaggtgtatcacagccttcttgtatttaggaacaccagacagcatttcaacaccatacttgggggccattgtaaaagacaaatcaccaataaaaagcacaaaaatgagaaaaatgtggccccaagtgtggtatggtaaatgcacttgcttatagcatgagagctgaaacaagaggcagaaagcagccttgtctgtcctcagctggggacatgctcactgggtgactcacattttcacagcttagtcgatgcactggtctgaatgtttgtgtccccacctttcccaaatttacctcttcgaccaggtgaggatacaacaagaaggcaggcccgcactggatcctaagtctgctggtaccttgagcttaaccataacagcatccagaactgcgaaagaaaagaaattctgcttacaagctatccagtttatggtattttgttatagaagcctgagtggactaagacacacgcttcctcaaatgactgtaaaattgctgcaagtattaattttggagttacaaatcaatttaagcaagtaggcaaatccacacatatgatctgtgaataatgagactagtggtaaagacttgaactatattaatgaataggacatagtctctgttttcaataaatttattcatataccatatttttctaaatttattcatatactatatatgtttttctcaaatgagaaaaccatagagaaaaaaaggaaagcatttagtactccagttttcatatatatatacacacacacactaacatatatgtatatattcattcattcatactgttgttgaaggcctccaagctgaacatggcctcagtctcatcagaacacagacaccctatagcacgtagcccctcaaatacatggtgactatcattttaattgagaataatggtgggaactttcagaaatgttctgaaattagtctaacgaatatgagagtaatttaaggaagttttaatactgccagttgcagtaaaaataattgaaaattaaattacatccacaggaaaatatggaatacctattgagacatcaacattgggaaaattagcatgctgaaacagagccaaaaagaataaactattttctctctgtaggaattgaaaaccctctggtattggactgtatgctgatgagtctaagttggaatacttctggtgtaaccacatcccgggggaccattatgggatacactgttgttctgacccaccatatgccactcttcttgcctgagtcattctctagtatttttctacaatggaagcatctagaataatttgattgctaagggaattaacctgctcagtggttctttacctaagcaacctctatagagcagtgtcttagtaaggtgggttaaagattgacaggtccactgctgagggtcactatacttacaagaagaagagaaacaaagttccagcatccccttgctacctccctcagtctgcctaaattccttcatcagtgctataatggaactcttatatacctcctctgttgcaatttttatttttttctccctctatactgtacgtcactgtctattgtccacttgcctactttcccatatataaataaattccttgaaaacagggatgatgttttattcatttatgtagtttaagtctttagcactgtgttcaatatattgaaagttctcaaagacttttgttaaatgaaggacggcggagatctaaaaagaatcagagatagggccagagacgaaaagatatgaaaccttccgtaataatagtctgagagaagcccacggctgtcacacagagaggagaaagagagcatctgtttccatcgctgttgtaaagttggcctgccctcctttccatctcctcttcaatgataccatcttgacatcaatttttattcagaataagcattacctctgcatcattagacttacatgaaatttggtttctgaaatatctgtttttattccctttccttgatagagaggatgaaggctaagggtgatgaagtttactatactcacctgctgatcattatcactagttttactcaaatccaataagccaaaatggatacttttcttaaccagctgtcagtctttaagattgcctctgtaagaggcaacactctatagaggttgcttaggtaaagaaccattgaataggttaagtcttttagcaatcaaatcattctagatgattccattgtagaaaaatatcagagactgactcaggcaagatcatttcaagatgagtggcatatgacggttcaggagaacagcgtatcccgtaatggtctcccgggatgtggttacaccagaaatattttaacatcctcatcagcatacaaccgaatacattggcacataggcttctctttttctaaaagatgaagacaagcttcttcctttcttttatgaagaggggattcctatttctatgaagacctggtatattggacaaaagaaatgtttgctcatatttattttatagaaaacacactacagcttctctttttatactgtacaaaatttagtcaaaagttttattgagatgttgaaaatgcttaacataaaaatttatgtaaagaacttgtttttcattaacatcaatccactgtaaacagtgaataaattatctcatctaaacaaaaggaaataattgaaaatatatgattatgtaactgctcatggttcagatgaaattgcctgatgaaagtcaactattagagtggcttaaacatttcgtcataaggataaaatggacacatctgatttatgctactgttcataacaaatacattatatttccaactacgtgttttacatgattttcaaactatatttgtggataaattttgtgtcacttggtaaaa[450 bp omitted]aaattacaaagtgtgacttaagttgacagttaaatggctagtgtcattccttcacaatttctagtttatccaaatgtgtacatatatatcatacacatacgctttcacataaacacacacacacatatttttgaagttataaatttcctactaaactcttctttagatgtcttttagaaaattttgttattttatttgttccgttaaaatattttacaatttctctaatgatttttgactcatattccatatgaagtgtgtttaatttctctcatatttgaggatttcccaaattactctgtgttactgactgctaatttaattttcttgtattgtttcatttctttttcattttttcactcatattatggcgcagaagatgactaatgtgaaggtttgtgtgcttttgaaaaaaaaagtgtattccgttgtgctgggtgtaacgttctgtaattatcaattaggtgaaattggttaagaggggccagccgtggaacttgggctgggtgggggtgggattgaaaaggagcataaggaaactttatgagctaaaaaaatgctctatatcttgagggttgtgtattttatcatagttaattatatttcagtacaggggtttaaaacaaaacccaaatcaccctccagctaaagcttcagtttttggtaattcttaacacgaaacacttaaaaatagttgtccacactcactgcttctactttctctcctttgcttctttctaatattgccgtaaatcagatttttacctccacgacaacactgtaccatttcaagaatcatcaaagacttccacattaatctcctggtatgcatgcgattacttaacagttactcactgtctctcagcttcaagctccttctctgtcttctttcatttctccccctttctccccttttccccctttcgtttccttttctttcctcctccctgtctccctgcctctgtctctctttctctttttctttcttgttggagcttggactctgactccatttccagcaggattttccgatttttttctgttcattaaagatgctagagaggaatgaaaagttggtggaaggaataggacatctttcctgttttctgttcctgtcagaatcagttcagtagcaacaaactgtttacttactcagctcctggactcctttgacattttcagcatcagcaggaaaaactctccctccaagagataagcaccagctatgtaagtttaagctccagcatcacagcgccctcctctgtgctcttttgtttcatgaagcccacctgttcccttctgtgccaacagacttagcaggtgagttgcttcctgcagacatttatctgtgtgtgagctcagcattccatttttcctccttcagcttgacaataccgtgtaaccaagtcctggtattaattcctctctctttacattacttagtgtggcttttgattttctgattagtataaaatgtgatactaggaatgacgctggggacatacattcaaatttgagactgtgactttgattttgctaagcatttggaatcaaattataggaagagatttttgaaacttgaagactatgtacctattttgaaaacctcctttcctgacaatttccacagcttttgatgaagttactggaagaaagtggtgtttgggaaagatcagaccaatataaatttattaacaagattattttaataagagatatccattgtcatactttttattagaggatattaaacttgtatccatgtatttggtaatctactctttgttttggaatagacagttgagtttgtattcagtttaatatgtttagaaataaagagtacatagctaataatagaaaacatagaatctcctatcagatttggccaaaaacttgtagtttgatcttgggcaaacacttaataacattggattatacatttctcatgtgcaaaatgaacaaatagtactatttgagtattaggttctcttccagttttgtggtctcaaagtaaagatacagatgtttagattcaagcttttttacccatgtgaattaaatgtagataacctctgaatcatctcgcaagagagtcatacttcaaaacagatgagagaaaattttagtagagactaattttggaagattaaatgctatgaaatactatatttttcttatatttagcaaaatattacattagaaactattaaataattcaaaatataaacaaattataagttttaagcgaagtaattttaagttttaggggaagtcatttttgatataaattagaatattcttcatccaaaaaataataggcacagttacctttcaaatagcaaaataaggattgaaataagtaaccccatgagagcagcaactcaggagactgtcaacctgtattcaaattcccgtttgatatacgagttaaacatggaagttcagagatcatgaaggatctgcattcataaaaagcttcttagatcaagggtaatatagattcatcattactacattatttaattcacagttcatttttgaattttagttgcaatagtatttgtatattttatcaactgattctaatagctccccgaaactttttgatgttcaaattgttccctttttccgtaacagtgtgtcatcctattgccttttcttttcattaattggaagctgatcgaatgataccagttcatcatttggggtgtataacattttccacttcacagtaatagactttctgtaattttccatttttctaatatttatgggttcatatatggtctcccaaatttcatctaccttattttattattccatttcgttactcgatatttttcaaaaaacaacagaagcaaatcacttcatatagaaaaaaaatcaatggccacattctggttccttgaaatcttggtctacttgattcaaggcccatttcatgcttgtgaagacagacagccctacataaatacctaagaatcaacgcaggatctataatatcatggtcttcctagactttggttgtaccttctataattactaaatttattccacatggtaaagtcacagaaaaaaatcattagattcatcctcaatttttttttctttccagaagaagaaatgcttttcaaaaataaaaaaaaaaaacttcttacacaaagcatttatgagagcagcagtctttaaaagctcactcattgaaacattcccactatttctttacttcatataacgctcaaatctcccacagcactaattccattttattctttccttctcatactttcatatctcaccttcgtcccttctttgcccttaaaaccctaagttactgtcttttgtatttccagacaaattcatcatcttcttttccagtgctcatctttattttctatttgcacatccgagttcatcaatatgcttaacagattaagagtagtcacattccttagaagttaactgtgttttacaaaacatcaattttgtttttcattgcaaatccaaatactttctatatagaaggtcctactagaggatgaaaatattgctgcagtttcctgttgtaatgaccccaccactgaatcaagacggctattccccatcactgtgttaccattccctactctgattattttcacctgcatagagtctacagcgagaaaattctcctctaagagacatacctcaatagaatatgaaatactctgttttaaaaatataactttcaagcacttttatttaagcttcaatcagtctatcatcatttataaactatctactttggtactatccatgaagtgccaaagtgatgatgtttcctgttttacagtgagatcaaaattgtaatggattccaatagtttaaagaagctataaaatgagcgcatcaaggaagaaattgcttgtaagctgagtagacacgtttcaaaaagagtcagtaatatattctataggaatgttcttgccattgatatagccgatcaagatggctacaaatggtttgtgtgaagaatgaatacctactacataaatgtctgttatatatttctgcttgtatgctgttataaaactgatagaaagtgtctctagttctagtaaaaaacttgcctagttgctcttttttccactaaaataagtgcaactttgcactgattataagtaaaaaaaaaaaacaaaaactatcagcttatattttttggagtatagaattaaataactttactcaattcaagttaattaggtggtaggataaatcactgtttgatgcttgcactgattttacaagcctcttcatgagataatatatttaaaagtaaaatttccattttaatgcctaaaaactgaaacttatattggagagcgttattgtttcttaatacctttactcagtaaatataggtaggttatttttcttcctacttttgtggggatgtttgaatgtcaaaatgactttttatgaaaagagtaaaataaaacactcataaaataaattatatgcaaaaatgagttaaatatagtcttttcggtcactgtatgtatcacacataatttgtatacaacaaagtaaatttttaaaaattttttttcagatacaaaactatacaatgaggatttaactttcaattgcaatactttacaaaatgctattctaggttgaatttctccaccgtgtgtgtgtgtgtgtgtgtgtgtgtgtgtgcctatgtatagtaaaatctacgtataactatatttatatatatttacatagatatacagatatatctatatctttgcctctatatatcacatataaatatttaatacagagaaactgttttcaattttgtcaatatcagaatattttctttctgttaacacaatatcacattttatgcatacacacatgatccattttagtctactttaagtttcattttgaagacaccacttgcatttgttaactgcccagtttgagctataaaaacctggactacagcagtagctttctgtgaatagagattgatattaaagcaactgaaaatgtttataaaatgctattgcctactgctgatctggggatttactacacagtttattagactttttccttcaccattgatagtggcaggaggcagacaaatgcctaggtagatagggacgggtctccagtgaaaccccatcttcaagtcaaatacagcctgagcctgaaagacctggctgctagttccagatgaaacctgagacctgaagtaagaacttctattactgtttgcctgtgctttcctgatttgttctttctgaataatgctttttaaccaatcaaatgttgctttttccaataccacctatacctgccactgccccatcctgtgcctataaaaatcccggacctagatgagctaacttcaggtcagagaccaccttctcctcccctgttcgctgagagctgttttgtcgctcaataaaattctttgtcctcatcactcttgaactgtcagcgtgacctcattcgtcttggacatgagacaagaacttgggactcactgaacacaagtactcagaaggctgtaacactgtggtcctctgtcctctgggggagggcggctgccccacatgacaggaagcagtggcaaagctgagccagccccagagccaccagccagagcagggcaaggggctgacagagctgttaacatgtcactatccctagggctgcggatggcagaactaaaagagctaattagcaagtagaatcgccccttccggggcttcaaggtctgagcacccctcttggggtgccaccgcattcccttcggggtgacatgcctggtccagctgcaagccctgcctagaacctgcctgtgtaccggtgcttggaacagccagctggaccccacactcacttgctcacacacccactcctgccaggggctgagtgcgcagccacagtagccacggatttagctggtgcacaagccaggcacgcccgggcaggacgagtgggcgggcttcttcctgtggcaggtagcctggccaatcaagggccaggcaggggcgttgccggccagaggtccctgtctggcaaaatgaccaagaaaaattccgagtcaccagcacatatgaaggatagagcatgttccatctggtgattctcagtattattcagaaggaagagaaggactccaccttaaagtgagggagtctatcagaatgttggctgcggggggatgggcggttgaaataaacattggtgatgatttaatgatagtagcacataataatgctactctctttcctcaccattctgtagctcttaaactaatttgttttctattaataattatataacttttattctgatatttattgaatatttatgatgtgccagatccttacaaaaactttgtcttaattctcacaatctctctctaaggcagataatcttcttattctccttacatatgaggaaactgaaatgttaagtcacttattcatgttggatattgtaatatctagagctcaaaaagatgcccatatggcatcaaattccataatctaaaatgctattattgtactatttgtctagtgttgcctcaggttagtatcaaatgcatcttactaaaattatttattttaagaatattcaatatattttttgcatctagtaatgtgatttttgcatctagaaaaaacatgtgtttttaaaaattactgcagctgtgcatctgatcaaagaacaatagatttaatcactgccttgaaggtgctacacattattgataataaaatattaattttttagatgaaatatatgcatcctcaaattaaacatttcattttctactgcttttcaaatgtattatagtttatttttcaataatatttaaaataatgagaattgatattcttagtcagaaattttaaaggcaaaactgattactgcattaacttagaactgaatgatctgtacaaaaaaggataaaaagatcaaatgtaaaagtaggtcttaatatctaggtaaactcacactttaaaatgaactttataacacttccttagcattttgtagtgcatatgttttttgctcttttttttttttattttaatagaatgtgctataggagggcaggcgcaggggctcacacctgtaatcccagcactttgggagctttgggagacccaggcagacggatcccatgaaatcaggagttggagattagcctggccaacatggtgaaactctgtctctactaaaaatacaaaaattagccaggcgtgtcggctggcacctgtaattccagatactcgggaggctgaggcaggagaatcgcttgaacccaagaagtggaccgtagggtttcttcaaataacaatgaaaataagctatttccagaataatactggtgaaattccttttgtttttctattttatgttgtttctgttatttagatgtttaatactgaaatctatcccattcagtgctatgctttctgactatatcattttaaaatgctgtgtcctcagtttttgcaatttaaattaaatgttctgcttcatgtaaaattgtaattccaagctctttagccaaaccatgataattttaaaaagtgaagaactgaaaattatatgattttttgaatttacttagacaggtatacaataataattaggtaaaaacaaaatcatctttggaggtctgtggtcactcattttggatgactatattaataaaattaagataactgttatatagcttatttattttattctttgtaacattatcctgaaaatgcaagaaagtctgataatagcttattcttagctgtatttataaaatgactaccaaaacaatatgcttatttcaaagttatagtcataaggggaagtgttaatatttatccggcttggcacttaaaggattttggctctaatattaatatatttaatttgcaaattatttttaggacatgaaacacttttatatgtaatataccatgttattcttacagaatcactacaaggaattccatttgacagatgagcaaagtgaaaaaataaatgattaagtaatttaccagcccacataactaatgtgtggcacccaaagcacttcttgacagaattaggcattaatttgtatgaaactacatcataactacagataaatatagtcagtaaatactagttgatagacaggtttttatatctatatataaattgttttatcctcagcatagttttagaacataacaacagtttcaatagtctcctacaaactacaaagttatgttctatttcttcaaacttctcagatatttaaatatacaagcaagcaaaaaatattagtcttagcatctgtttgtatgttgtttaagtttttttactaaatgttactttttgaatttataagggaattatgatgatcgctaatggctttgtcatttcatagcaacacttgatttattatacgttatttatcttaaagaatatgttgccagtcaagtgagtttttcatattttggcatgatattatatgttaaaatcttcaccactgtaaggtcaaaaaactgcaaaaaaacagtaagtaaactcagaataatttgaataaggaaaattaaaagagcagaaattaatgagaagaaaaatgaataataaatataagtaagtgacagaaacaaaaattgcttcctggaaaagacaaaataattcgtaaatctctaaaaacaaatgacctcaaaaaaatgtaaagaaaattcataaattgcaaatatatagaatgcaaaaggatacaagtaatcatcatagagttactaaaatgatactagtttatgcaaatatattcaatgtcttggggcaactattttcgaggaacttaactgtgtcacggaacaagagtcaagaatatcagaatgcaaatatatccaacatcaataaaataatattcctaatgtccactatgcaataaaaaataagcaggtgtgcaaagcagcaagaaaatgccacccataatgaagagaaaaatcaatcaagagagacagaaatgatacagataatagaattagtagaaaaggacattgaaacaggtattacaactatttatatgttccagaagttagaggagtgactgagcatgttttacacattctgaaaaacacataaagatacaaatcaactttcagaaatgcaaagttcaatatctgagatattttaaaatcacctgataagattagaagcacactgcagaagaaaatctttgtgaatgtgaagatacagcaatagaaaattttcaaactaaaacaagggaaaaagatctgagggaaaaaatgaaccaagcatcagggacttgtggaacaactgtaacaataatattcggtaaattagacttaatccaaactcaaaacataaactttttaaaagacacacagaattaaatattgcgagaaaatatttgaaaaatgtatatacttaaggatttgtactagactatgtatatataagtgtgtacaaattcatataacattatctgtatatacacattcagtcataagataaatagcctcataaaaattatctgttgaacagatacttcaacaaaaatttatgttgacataagagcatattaaaaccacattctggaccataaaacacatcttaacaaatttaaaaatggaaattatacaatgtttgctctcagaacacaatgaaattaaactagaaataagtaacagtaagatagctggaaattttctaaatatttgtaaattaaacaacacatttctaaataacatgtttttaagtgaaaatgaaaacacaactcgtcaaaatttgtgggatgcagcagaagcagtgcttagaggaaaatttgtggcattgaattcatatattaggaaagaataaacatctaaattcaattatctaagtatttggaaaactagaaaaagaaaacaaatcaaagtaaacaggagtaaagaaatgatctaaattatagcatgaattaataaaattaaaaacagaaattaagagagaaaataaaagcaaataaaacaaaaactggttttttgagaagaccaataaaattgataagattctaggcaggctagctaagaaaaaaaaagatgaggaacaaaaagtattaatattataaatgagagagaagaaatcactgctgatccagtggatattaaaaaataatcaaggaatattatgaaccaacctgggcccacaaatttgataacctgatgaaaaaggcaaatttcttaaaagacgcaatttgtcaaactcatgcaagaagaaatagatgatctgagtaagtctgtatctgttagatactgaatctagaaccaattgccttccaaaacagaaagcatcagacccagatggacttgctggggaactccaccaaacatttaagaaaaaattatacaaattattcacaatccctttcagaacttagaagcagaggggaaactttccaactaattctatgagatcagcatttccctaatgccaaaatcaaacaaagacattagaaaaaagaaaactactgaccaaaactacataactgtcatgaacacagatgcaaaaatcctcaacaagatgttagtaaattcaaaccactaatttatagaaagaattgtacgtgaagtaaattcattttattcccagtatgcaaggctggtacacccgtcaaaaattaatgtaatccatcacatcaagttgctcaaaaaagaaggctcatataattagatcaggaaaaaagcacaaaacacacacacacacgtgcgtcacaaaatccatccatgcatcataaatattctcaataaactaggaatagatggttacttcttcaactgggtaaaaaacatttacagaaagcttcagcgaacatactaaatggagagaaactagaagctttcctactgagagcaggaacaaggcaaggatgtccccctactattgcctttcaactttatactgcaagtcctagctaatgcaataagacaagacaaggtaatgaaaggtatttagattaggaaggaagaaatagcactgtatttgcagatgatatgattgtctacgtagaaaacccaaaagaattgaccaacccccacccccactggaactaataaacaagaatagcaaagttgtaagttataaggtttataaggttaatatatacaagtatttctctttcctatatccagcaatgcacaagcagaacttgaaatttaaaaaaaaaacacaatccctcttatatcagtactatgaaaaataataagtataaatctgacaaaatatatgcaagatatgtttaaggaaaactataaaagtctgatgaaagaaaagaactgaatggagagatatatcatgttcatggatagaaagattgaatattgtcaaaatgtcagttcttcccaacctgatctacagattcaattcacttccaataaaaaatcccagcatgctattctgtggatgtcaacaaactgattctaaaatttacatagcgaggaaaaagacccacaataacaaacacagctgtgctccttgatagttaaccaaaggagctgaaaacttaggttcacacagacacacacacacaaaaattgcacatggatgtgtaaagtggatttattcacaattgccaaaatttggaagtaaccaagatgtcctttagcaggtgcatggataaagcaactttggtttatttacatccaaacagtggtgttttattcagtattaaaaataaattagctttgaaaacatgaaaagacaaggaggaaacctaaatgcatattactaagtgaaacatgtcaatcttaaatagctacatactgtatgattctgactatatggcattctggaacatgcaaaattatcgagatagtaaaaaggtcagtggttgccaggagttatggggagagggaaggctgaataggcagagaacaaaggattttgggggcagtgaaagtattctgtacactactctaatggtggtctcttgtcatcataattttttctaagcccaaagaatgtataacactaaaattaatccttaaggtagactttggatgataatgatgagtcaatataagttcatcaattgtaacaaatgtttcactcttgtgggggatgttgataatggggaaggccatgcgtgtttaagggtattgctaaaattaaacatttggatcatatcaagttttggagaagctgtgttacaattgaaactcttatacactcttagtgggagtataaaatggcctaaccatttgcaaaaaaaattttgaaagtttcttaataccttgaacatctatcagtcatatgactaagcaatgattacattgtattacactgtatcttgttatataatatgttaatatatattacataatatagtaataatggccacaatattattagctattattactagctaccattactaggtatttacctaagagaagcaaatgcttgcatgcacacaaaacttacataatactgttcagagaagctttattgcaatagctcaaattggaaataacctaaatgtctatcagtatgtaaatgcagaaaacacattgtgctatatccatacaatggaatagtgctaaacaataaaaataaataaactattgttatacacgatgacatgggtgaatctcaaaataattatgttaaataaaataagccataccaaagaagcacatcttctatattattccatttacataaaattctaagaaatgcaaaccatattggcagaaaaacagttgtgttttttgtttgtttgtttgttttttgcctggggatggtagagatggactgagaagtgtgagagagattaaaaggatcacaagaaaacattgggaagtgatggacatgtttagcatcctgatagtggtgattagaaagtgcaatcatggaggagtacatatgccaaatttactaagttgcacactgataaacctacacaatgtttataatagctaaaactagaaagactggcaaccaattgttggcaagggtttgaagcaaaaggaactcacatatatttcctctgaaagacattatcttacgataggaaatatatatttaccatatgatggtgctattccatcctttagtatttacgctgcaggaatcagaacaaaagagttgttcatatgtggtcatagcaactacgctcatgaaatcccaaacttggaaacaactcagacgttcatctatggtaagtgaatggctcatggtaatatacgatgcatactactcagcagtaaaaacgaacagcctaatgatgcataaaaatagtgatatgtgttataacttatactgtgagaaagaatccagccgaaaatgtacatgtatgattccatttatagtaagttctggaacatgcagaacactgtttcagtgatgaagagcaaatcaaattgcctagaactgaagctgggaagttattatccacaaagggaaaggtttctagagactttaactggtggttatacacatctgtcaaaattcattaaaatgcacacaaaattggtgctttttattgtataaaaattatatctcagtagatttgaattaaacaacacgaaagaatcaggttcccaagaagctgaatcttgacacattgacgtgacttttttttttttgagacggagtcttgctctgtcacccaggctggagtgcagtggctcgatcttggctcactgcaagcaccgcctcccgggttcacgccattctcccgcctcagcctcccgagtagctgggactacaggcgcccgccaccacgcctggctaattttgtttttatatttttagtagggatggggtttcaccatgttagccaggatggtctccatctcctgacctcgtgatccgcccacctcggcctcccgacatgacattttatatggctattgaaatgcaaaattttgctaccttgtatttttgtaaaactgaaattcacattcagagctaaggtcgtgataccttgattcagcagttgaaaaatggcgtgattacaaatgaaagcacaggtctacccatgaaatgcccaaagtccagccaattcatttcatgtatgcacaaacttattggacataattcctttttaaaaaggttaacttcaatgtaaccactgaaaagctaaattatgaattattttatgtatataacggttttgtagaatttattatttttccatgcttgacctaacttaattctacataataatgtaaaagttacccttgatttttgttagaatatgtgtcactatccagtgaggaagcttctcagtatgggaaatgctaaacattttatatttagtgtagatgtagttataatagaaaccccccaaaatattataacttctggttaaaattagaattcagaatatttttcttatgtcctaagcagcttatacacaaattccattgttcactcaaggtgatgccccatagagttggcatggtttaatctcactaaatgtaggtagtgaagaaaaaaaaaaggggggctcttttcatctgatcacaactaaaaactaagcctaaattcaagtcaaggatatgtgagctatctagtcttatacccaaactccccacaatccaaaactgtttgttcaaatctgacccaaattaaagaagattgagcaaaaaggacagtgaaaactcaatctatttgctcttgtgacatgcgtttgacttatttatcactgctgggtctactgactgaattcacaagagaaattagagctctttgtattttctgcagcagaccaatttaatatgccaaaagactgttcactctcatttgcttcctcgacacctgacagacaaccgagtaaaacttttttttatttaaataaggaactaagatcaagagtctaatagttctgagttcaattcatagacttattacttgttagacttaacctgggcgaagcattccacttgggctgacatgtatagaatgtaataagaattgaatagagactgtgtggtaaattctttgtgggcaatgaagactagctgttggtagatattagggtcccaccaaaagagaaattctgtcataggaggccactggagtactataacaaattagtcaacctcaacatcctagataattggatttctgttgcttagacttggttgtttttacttgtcagcaatcataatcattctattaaataattatttatggccgggcaccatggctcacacctgtaatccaagcactttgggaggccgaggtgggaggaacatgaggtcaagagatcgagaccatcctggccacatggtgaaaacccgtctctactaaaaatacaaaagttagctgggtgtggtggcacgcgcctgtagtcccagatactcgggaggctgaggcaggagaatcacttgaacccatgaggtggaggttgcagtgagctgagagcacaccactgcacttcagcctggcaacagagagagattccgtcaaaaaaaataattattattatttagatttataaaataatacatgaaatttaatggttggtctattatcagcatatttatccatctaatcaatattcttccaattctgtttcacccattttttaattagtttagttattaaatcaataaaaagtattactgcagaatgcaaaaacatgaatgattctcacaggcaatatattgaaggaaaaagccaaacatattatcatcagatgattccattcatacaaagtttgagactagacaaaatttaatttgtagtgtaagaaagcagaattgttattatctctgggaaggaccatgaaagaatattctggaataatgtatattttgtgtaaggtatttcacccattttaatagttcataaatttatattagaaaggtcagcatttctcttgaggaatatatgaatataacaatccacaatattttttcatctgaaaaaaaacctccatagagtaataattgtcaaattttgcattattatctctaaaaagtaatgtcattcttctttgaatttttctctacattatttgtacagtgttagagaaagtgtccttgcaaactgtatttatgagtaacatattagttcagcctgagaacaaaaaattaataatgtcataggaaaccattggagtactataatagtgtacagatttcaacattccttttgcccatcaatttgtttaagatttgaagcagctttgggaaataatatttatatttaatataatattaaaattttaacatagttgttacttttattgagattactttcctctaatagttattttggagttgtcaccattacaacataacaatttataggttttgcttataaattttaattttaactttaatacaaccctgttttttgggtaaaaatgtgatattactacagtatctactcattaaagttaataatataaggctaaaactctttttcaaaataaacaacgtttgtttgcatacttattcccataaaaatggataaaaacagaaattctttacaagttatttcaacaggcacaaaactatgaataatttctcgaataattattcccttctaaagaagcaaaaaaaaaaaacaaaaacaaattttcctccatgagcttttcaagttttgtgtgattcattcatagtaaaatttgctttacccatttgttttttacaaaaggcaaatcatttaatgacacacatgagtggaataatcagtcaaaactaaaatttttatgagcttgagataagaaaataaacaccctgtcatttttcttttattttcgtcttttctacttttaacagccatacagaagtctaaacttaccacaaagaaaggctgctcccatgctattttataaagatgcagaatattatataattcagcttggtattaacatattgaaattaattattcttaaagttatcttagaagctgaatgtgaaggttcattttaaaaatagagaatttaattgtattataaactcaatatttaataattaaaatagcagtctggcatggtggctcacgcctgtaagcccagaactttgggaggccaagatggacagatcacttgaattcaggagttcgagatcagcccggccaacgtggcaaaaccccatctctacaaaaaattagctgggtgtgatggtgtgcacctgtggtttcagctacttgggaggttgaggcaagaggatcgcttgagtccaggaggtggaggttgcagtgagccaagatggcaccactgcaccccagcctgggcaacagagtaagaccctgtctcaagaaaagaaaaaaaaaaaattaaataaccacacaactaaaaatgtgatataaaatagaacaatgaattgagtgatctcttttaaaagaccactttgatacttcactaaagtttagtaatataattaataattaaaatcttagaaagttgttcttacttattataatagcatgttttctttttttcttttttcttttttttttttttttttgagacagagtctcgctttgttgcccaggctggaatgcagtggctggatctccgctcactgcaagctccgcctcccgggttcacggccattctgcctcagcctgccaagtagctggaactacaggcacccaccaccacgcctggctaattttttgtatttttagtagagatggggtttcaccgtgttagccaggatggtctcgatctcctgaccttgtgatccacccgcctggcctcccaaagtgctgggattacaggcgtgagccactgcacccggcctattttttttctttaacaatagtaaaatagacttttttcaccaaagatgttctgttttagaaaataagcaaagcaaataaaatttaaatgataaaataagaaaataattgaacctgaaggataagggaaattagttctttaacagacattcataatcttatatatagtctaatctcactaaaaatattatcctatagattattccatctttctactcatttttcgaattactatttttatgataatatagtcatataatttttccaattttcttatatttcattgatatattggtgcctactggcaaatatatatatttgaaaaagaaatatagatatctagatgtttatatataaatatgtatttttttctttctttctttttttttttttttttggaaatggattctcgctctatcacccaggctagagtgcagtggcacaatctcagctcacggcaacctctgcctcccgggttcaagcaattatcatgcctcagcctccctgagtagctgggattacaggcatgagccaccacacctggctaacttttgtatttttagtatagacagggtttcaccatgttggccaggctgatctcaaactcctgacctcaagtgatctgcccgcctcggcctcccaaagtgctgagattacaggcatgagcccccacacccagccctaggaaatagacatgctgtttaataaacataactttataataattttggctatttggcacagttcatcttttttttttcaaaatacctgtgctaattctgtgtctatttttcccagatgaatatgacagaacttgttttatttctaataaatctgttgaaatagtgattaagattcattatctgagaacaccatttaatcagaaattctgttattctgtaaattttacaattttcaaaatataaatattaagtattttgtgttaagattattgctaggtagttttattggtctgataattgaattagttttcttttgtgtaattaacttggttattgctaatgaatttaaattatacttgtttaatgtttattttgccacatacaaaaagtcttactttgttccttctcataatttgacagcagcttctcttggattttaaatgtagaaatctgataacttcctttatagtatcaatgtctcttcacttttttaggcccctaaagttacctgattttgtgtgcaagaccctcataatgttctcttttttattaatacacaaaaattgtacataaatatggggcatgtgatattttgatatatgcacaaaatgtttaatgatcaaatccgagtatttgggatatatatcacttcaaagatttatcaattctttgtgttgggaagatttaaatggttatcttctagctattttgaaatatacaatacattattgttagttatagtaaccctactatactatcgaacactaggacatcttccttctatcagactgtatgtttgtacccattaaccaacctctcctcatccccttcagcaccacctttcccaggctgtggtaaccatcattctactctctatctccatgagaaccacttttttagttcctgcatatagtgagaacatgaaatatttgtccctctgcacctggcttatttcacttaacataatgacctccagttccatccatgttgcttccaaagacaggattttatttctttttatgacagaatagtatatatatatatacacacacacactatatatatacacacacataagtacatatatatatgcacatatgtatacatgtatacatacatacatatatacacatatttctgtgtgtgtgtgtatatatatatatatatatatacacactatacacacacacacacacataccacattttaaaaatccatttatccattaatgatagaatccaggttgattctatatctttgctattgtgaatagtgctacagtaaacaggaggcagggaagtatctctttgatatacagatctgctttcctttggataaatacctaatagttggattactggattgcatggtagttctatttttatttttttgagaaatcatattgtataagtccattttcatgctgctatgaagaaatacctgagactccgtgatttgaaaaggaaagaggcttaattgactcacagttctgcattgcttggagacctcaggaaacttacaatcatggcagaaggcaacggagaagcaggcaccttcttcataggctggcaggatggagtgagtgcaagcaggtgaaatgccagactcttataaaaccatcagatcttgtgagactcactcattatcatgagaaagccatggggaaaactgcccccatgatccaattacctccacctggtactgcccttgacccagggggataatggtggttacaattcaaggtagatttcaatggggacagagagccaaaccatgtcacatgctgttttccataatggctatctttacattcccaccaacagtgtaaaacttctctttatatccttgacagaatttattacttttttgtctttattcatagcagccattctcgctgggatgagatatttcattgtggttttgatttgcgtttccctgatgattagcgagtttagcattttttatatacctgttgtccaattgcatgtcttcttttgagaaatatctattcagaaacttttccaaaccttttaaatgagattatatctttgctgatgtttgagttccttgtatattctagatattagtcccttgttggatgaatagtttaaaaatatatttcccattctttgtgttgtctcttcatttcgttgatagttttgttgctatgcagaagcttttaatatagtcccattcacctttttatgtttttgttgcctgctcttttgattatcttaaccataaaatatttgcctagaccaatgtcctaaagtttttctcatgttttcttctagttgttttataatttcaggtcttatgtttaagtatttaatcccctttgaattaacttttgtatatggtgagaggtagagatatatttgtatccttctctatattgacatcttgttttcacaataccatttattgaagagagtttccttcccccagtgtatgttcatagcaactggtcaaaaattagtcaggtgtaaatacagatttattttaagcttttctattcttctccatttttctgtgtgtctaattttataacaatgccatgcgttttagttactctagctttataatacattttgaaattgggtattgcgataccaccagctttgttttgcttggtatttcgatggtcatttgagtcttttgtggttccatacaaattttaggattgcttttttctatttttgtgatgaatgttattggcattcaaatagggattgcattaaattcaaagattactttggggaggatgggcattttaacaatatcaattcttgtgaacatgagcatgggatatttttccacttgtttgtgttttcttcaatttctttcattagtgttttgtggtttttcttatacaggtcttcacttccttggttatatttattcctaagtatttaatcttttgtagctatcgtaaatgggattgtcttcttgatttctttttcagctgacccattattggtgtatagaaatgctactgatatttatatgttgattttgtattctgcaactttacacaatttatcagttctaagagtgttttggtgaagcctttaggtttttttatgagtttatgttgtcttcaaagaaggacaatttgacttcctcttttccagtttgactgcatggtatttctttttcttgtctgtattgctcaagctaggattttcagtattacattaaatgacagtggtgatggtggatgtttgtcttgttctagttcttagcagaaaggctttcagctttttccctttcagtataatgttagctgtggatttgtaatatatggccttaattatgttgaggtatgttccttttatgcctaatttgttgagaatttctatcatgaaggaaatttgaatattatgaaatgccttttatacatctattgaggtaatcctatggtttttgtcctttaccctattgatttgatgtatcatgtttgttgatgtgcatatgttgagccattcttgtatcccagggataaataccacttgatcatggtgtattatcttttcaaattattgttggattcagtatgctagtattttcttgagaatttttgcatctatgttcatcaggatattggcctgaagttttcttttagtcattatagaatccctatgtaacttgctttcagggtaatagtgacctcatagaatgaattaggaagaagtccctcctcctccatttttttattaatagacaagaattggtataagttcttctttacaagtttgatagaattctatcataaagccatgtggtcctgggcttttgtttgatgaagatgtttactactgatagtcttgtgactcattattagtctatttaggctttctatttcttcctgattcaatcttggtaggttgtctgtgtccaggaacttatccatttcttctaggttttaaaatttgttagcatatagttgttcataataatctctaatgacttttttttactttgatggaagttgtaatattgcctttttatttctcattttttgtcctctattttttcttggttagtctggctagctatttatcaattgtatttatctttttaacaaaccaacactgcattttgttgatcctttgtaatttttagtctctatttcatttgttcttctctgatctttattatttctttccttttaccaattttgggtttgatttcttcttgcatttctagttctttaaggtgcattgttaaaatttttatttgagttatttctactttttaataaaggtgatgcaggcatagaaagacaagtactgcatattgtcactcatatgtgagtgccaaaaaagttgatctcatggaagtagagagtggaatgagggtgaccagaggcttgtaagggtagtgaggcagaagtcctaaagataaattggtaaatgggtacaaaaatacaagcagatggaataagttccagcctttggtagcaatgcagggtgactatagttaacaataatttattgtgtatttcaaaataattagaggagtggattttcaatgttttctcaactcaaaaagtgataaatgttttaagtgatagatatagcaattaccctaatttgattattacacattgtatggttgtatcaaaatattacatgcactccataaaaatatacaactattacctatccatgaaaactaaaaattaaataaacataaaatatttaaaaaatgactggggacttgtctgacagatcataggaaaaaataaatacaaataactttaaaaaatcctaattttaattgctaatacattatttccaaaatacagtcatgagatttattttttcactagaaatgagataatgtcaaaatgtgatataatctcagagttaaatgagataatattgtgatgctcagtatatgaggaaaggaacgttcctatacattttttccaagtaattacttaataactctcaaggttacaacttgtcataattataattacaattaatatcacttgaattgatttagcaactcaatttttaggcattattttacacatagcattgatcccatgggcacacatgtaaaaataggtatttataatgtcattcattgaaatatatttgtagtaacagaatattatgaacaaatttaatgttcatcaacagaaaactgatttaataatgtatatgttcacgcagtagaatactatgaaacaaagaaaataatgcaaactaaaacaaatagacaaaaatcgtgtgtcactgctgccagggaggtgaaaactactcccaagtataataccacatgaaaaagcaacttgtagaacaaagtctgtgatgtatagcacctgggatggaaagacaaaaggaaaagataaatgataatagctgggctaatactcaagcaaagtctcaataatttttacccctatggtaacaactatgaaaatttgagtcccaagggaaacaaggccagtggaaggtttactgttcaacagattaacacctgtgtagattgaattttaatttatctttgtgtatattacctattccaaaacaacttaataattttaaatacatttacaacacgtgaacttgcttgacttgacttgaaaccaaatcttagttaaatccaaagtaagacttgttaatatgctactttaattttaaaaataatgttttcaaaactcactaaatcaaaacattaatttagcaacatactgtgtcacagaagtttctgtatgattcatgaaatcaaagcactacatagtaaaaatgtgctttgtggccaggcgcggtggctcacgcctgtaatcccagcacgttgggaggctgaggcgggtggatcacgaggtcaggaatcgagaccatcctggctaacacgttgaaaccccgtctctactaaaaaaatacaaaaaattagctgggcgtggtggcgggcacctgtagtcccagctaatcgggaggctgaggcaggagaatggcatgaacccaggaggcggaggttgcagtgggccaagatcgcgccactgcactacagcctgggcgacagagcgagactccatctcaaaacaaaacaaaacaaaacaaaacactgtgctttgtgctaaataactaaatatataataaccacttgtaacaactgaaaaattctttgaaccactaatatatattgctatatgcgtaaaatatttagaagcaaaggatattcctgttctctctaatacataattcttggttattttattattttgtgaatgacatctgactttcaagaagattatttatttttaaacagcaaacgcaaaccacaaagatagaacaaggttcccttttaaagttgcatgactttcaaagttatagttctcttttgatccaagtatatatttgagtatctatttcccttcatacttttgacatgttagtaatgagttgaaacccagtctgatggctaatattgtcttaacatgatgcatttgctttaacgaagcattatgacaaatactttttgattgcaacatagttttcttcattggttgttcaaaagtgaccaattttagtagctactctgaaatatgtagaaatatatgtttcaatccaagttaatacattgttaatgcatttcaagtgtttgtgcagagtcaacatggaaattgaatttcatttgaaagcaaaaacaagttaccacttctcactgaagtgtttatgaatatgtaaatgttagtctaaatcatagtatagagatcttttctgaggcatctttaattatctgaaaggataaatatgagactcattgtcatttgtaagggaaaatgacaggctgtaataaaaggaatgaatgctaagcatagatttaaaaactgtattacattaaacaatgtgaaagaggatatggaaatactaaagatctcaggagacccagataacatttaacatagactctttcagtaattactcatattgtatgactttcaaagttatagttctcttttgatccaagcatatatttgagtatctatttcccttctattttattttatctattttaacttctatttcctcttgatttgctgttaactggttataatacataccttaccaacttccaatattggttgtaatgacaaaacagtgaactatatatgaaaaatctttaagagttatataaaacaccaattaaacatattatttttataattctagaagtatttttattatttcatagttgtgatgactgaactaacaataacccaagtaattaaaacaaatttttattagtatttattaaataatctatatgtgactatgaataatttgccattaactgtcctggaaagaaggaagcttggtttcagcatcctatgcctctggaaaagaagaaaacataagagaatcattaaaccttttaaaagagactgggagaagtattgatgaatttctcataaatctattttcccttgtactataacagtactctccagtttctacgtgcattggaaaaaaagttttgattttgtttgacttaggaagctaacttttttgtgaaagagacagatactcattgtccttcccagctcttcttggatggtttggaaagagctttcctctaattctgatcagaagtagcagcaacagctggttctcctccctctgatggagattaccaccatttcctttcccaccccagctgacgacggtgtctattatttatgatcattagattacactcatccctcagcttttgggcaggtatacaaaaccaaatcagcacatcaatcttttcctctctgagtttccagtctacggattcacacctgcctctttcccatatttattaggcaaaagcctgaatccacagatgggccttaaactgtgaaggaaaggaaaacaaaatttggaagaatcaaatgctacagataatttcataatcttgattatattttttaaaaagtaaaaaagattagcagttgatattctaccattgcgattctcattagcaatgtttaattcttactaaacatttttagatgaaaatgcaataacatctgtaaatacaaaaaataaaatttatgtttaaatttattaatatacatggggaaagaaaatcctttccgatttagtaaagaaacaaatactaattccttgtagaaacactgagtaggcctaacggatagtttagaaactgggagaggggctaaacgttgttcacaaagaaaatacatgaaggtgttcctaagcaaatgcaccaagataactctattgaaataattccatgaaattcaagttcagtattatctccacttacccagttgctgcaaagcttaaagtatttctatagtcatacccacatgtacaaaatcatcttgatgcttggttaatattattgattgccttaagcactgcaattaactaagttatttggccttttataggagacgtaaattgctggatactgtatcttaaacataagaaatataaaactaagtttgtaacttctgcagtgtataacataaatcaacattgaggccaggactttcctttagggttctatttacaaagccactataattgaatgaaaagtaagaatggtgagggtaagaccctgtgaagagggctttatttctgaactaaagatagatttttaaatacgtgccctctcacatagccttcacctgagtttctagcagcagctgtgccttgaagtgcacacaggagctatgaaactctaaggggaataaaaggactaaaagaggaaaaaaagttcaagacgtttaagtcaacactataattatgtagaaataaatataacatgtaacatatcaattctgataatagcctcaatatgtcatctacttataatttccctgcttttaagtagcttatactgaatcaaatcgaagttatagtgaaacgaaccaaggccaaaactgtttaattgtttagactttaagtgaattaatgtcacctaactgcttaagtgaataattatgaggattttaaagcccaaaattttcttcaaatttctgtctctattgttatttttatatatctgcagtatattttaaatagtaacatttctttatacacatcattatttccttatctttcttcatattcatatcaatctatctaacttaaggctctcagaataacaacaaagtatttcaagttttcagtcttagaattgtcaacttgttaaaaaaaaacccatgttataagtcatttgaaatgacaacttaatattaacaaaaggtctacatagaaaatactgattcaggaaacagaatatagggagggaactgggagctagttcccgaaaccccactgctctgagctggggatgggttggggttagggctagtaaaaacaccatgaattttcctatttttttgaatgtggctttttcttagttggatatttatttgtttgttgtagacctttggctgtttttctgagttcctataaagttattttagccagtctctagttttttattttattttaacgtttctgttttgtttttattattattattttaatgcctctggtataagagggcctggaacttcttggttccagccatatggctgaaatcactcctctggagctatttttaaagaaatattttggctcaacaaaattaaacactggcatatcaagtaaattggagtaaatcaatgaatgggtcttcacctaaaaccatgtgattttcttataacatagtgatcgtgtatgctggatttaaaaaaatagcaattataccaataaggagtttttgtccaaaaacttgtcgaaaattgttaactgtatcaaacatgtaagatcattaaagtaatgtctcttggactgccataatccttattctacatctcggacaacttagcgcaacacattttccatctcagtgacctacatcttgggtaaaaagctgttgcaatgaattatgataatatgtatatcataacatagttagcaaatttaacttgtattaaacactaggttaaacacgtttagtgttagcaactctatgtcatataaacacgtgtgatggaaaatgccataaggaatgtgatagatatcaggtacaaatgtagattcaaacagcatgtgatcctaacttccatatgtaaatgctggtagtcctgaggattcacttattacaatgtttgaaatctgctattacttatagtaatcaatggcacttttaatacctttacttctcttcaactttccttttttatgatttatatctctcaaatatttcagcctgtccatcatttatttcggtaatgtatgtgtcttttccaaaactgacagaagatgatcttgaaggttataatgaaattatcacttgaaaataaaaatgcaatattcccttttaacccatgtaacataaagctgtcttagcactttcttacaagtaggataaaaatgcacaaatttttcaattatgctaaaaactaacattaggttgatggaaaacccgcaattacatttgcaccaacctaaattataatcacagtattatacttttgttgtcacacaatttctaatattatagttattaatataatataaacacaacataaattttaatatataatcctataaatataggatctataacttctgactttcaaactgtaaaactttctgtacttattaacctattcagaaatcaaaccaaaagcttttaatttaattttaaagtaattccatgattctgcatgaccaattttccagtctcaatgccaaatatttccaacatactttccaactttttcttgaatctccttatagtctctgtgctcttttctattaccacgtttatacccatcactctgcttcagaaacagattaattgcatcatttcttcaacgaatatgtcttatttcatctctaccctcttcacaccagatgtatgtccttctcctaccgttggtagaaatggcttcaaatattttgcgtaactactatttaaataatttacaaactgtataatattttactaagtttatgtaagattctaaatcttctgttgtcatttcaacaatattcacagcatcttcactaggagtagcttccattacaaaaaactactttctttgctcacacgtaagaagcaatcctcatccattcaagttttatcataaaattcagcaagtcaatcacatctttggcttgacttctaattctagttctcttgctattttcccactacctgcagttacttcctccactgaagccttgaaacaatcaaacttattcatgagagttggaatcaacttcttacaaactccaaactccagttaatgttgatattttgacctcctcccatgaattatgagtgctcttgatggcatgtagaatggtgaattatttccagcaggttttcaattgacacctggatccattagagaaatcactatctatggcagctgtagccttatgaaatgtatttcttaaataataagacttgaaattcaaagtattactttattcatgggctgcaggatggctgttgtgttagcagtcatgaaaacaataatctttttgtacatcttcaccagagctcttgggtgaccaggtgacttgtcagtcttttgaaaggaatctttttttctgggcagtaagtctcaaaaatgagctttaaatattcaatgaactatgctgtaaacatacatgctattttcttggctttgttgctccatttatagagcacagacagagtaaattaagcataattctaagggccctaggttttatggaatgataaatgagcattggctttaacttaaagctatcagttgcattagcccctaataagagagtcagcctctttgaagccaggtattgacttctcctttctagctatgaaagtcccagatgacatttcttccaacataaggctgttttgtctacactgaaaatctttcatttagtgtagccaccttcgtccatgatcttagctagatgaatttactgccatgcactttctacaaaaattcttgcttcactttgcacttttatgttatggagacagcttctttccttaaacttcatgaaccaacctctgctatcctcaaacttttcttctgctgcttcatcacctcttttagcccttatagaattcattgaagagaggtagggctttgctctggattaggctttggcttaagggaatgttttgacaggtttgatcttctatccagaccacattctccatattagcaataagtttgttttattttcttatcattcacatgttcactggtgtagcccttttaatttccttcaataacttatcctttgcattctcagcttggctaagcggtgcaagaagcctagctttcagctgacgcctttctcactaggctttctcactaagtggcgcagtcagaacacacacatttgtcaattaagctagcagttttgtacaggaatgcttcatggtgcctcagaactattagaatagtcttaaataaaaattatagaaggccattgttttggactaaattcctgtactaggtccaacagaccaaactaaaaattaaaatggagtcactcatgctaaagttccatgtcatcaaacctaaactaagttgttatccgaccttcccacatattaggagagagatataacagctaattttcccaaactgaccaatatgaagtcttcaactggcatgacaatgaagtttcctctgctttaattcttatgcacataaaaaagatatcctgaggtaactcgatgttaactaataatttatgttcctattgttctgtccaaagtaactaatacactctgttctttgcttcggcttttttaatcccttttctgtctgtaaagccaacttcttctgctcaactcattggaagacttattctattttatagaatgaaatgttgcctgattctagaattgcaaataaagctgattcatatctttaatctaaatttgttgtaattttgactttcatcaatggtaccatcaaggattactaatcacagatcaccataacagatataaaattaataaaaaagttttgaagtattgtaagaatgaccaaaaggcaacacaaagacacaaagtgagcacatttatcgtgcaatggataaacctcaccctgggaaaaccaccttcctgatcacggtatctcccctgccagttaagtgaagtgcatatttttggcaatacggcactggcagaactgttcaatgcagggttgccataaacctccaacttgcaaaaaatacaatatctgcaaaatgcaataaaatggcatataaaaatatgtatgtttatatgtatatgtgtatatatatgtttacacattaatatatgtatatatacacatacattcttttaatttcatgtaattatgagtcaagtgctaaaataatctattttctggattaaattgtaataattattagttctggattaaattgtaaaattaaaataatttagtcaaatatgcacttatagcctgtctaaccaattattaaatatgaacaaacgtttttcaaaatgcatcttagttaaaagaataagcctttgaaaattttgtttatgcatctctgagtaaatattactcattagttggataagaaatttggcattatttctattcttactttttaactttattaccataacacctgagaaaatttcttcatgtaaataagtaaaagagaaaagaaaacgttgggatgtagcaatgccccacattattgaaacccctactgatttaaaagttaaaatcatactgtactctgtcatcagaaatagactctacattttgttagttaataatttaatcaggttttatctcaaatttgtcctaagcaaagagttggaaaccactcttcttacacacaagtttgtttcctagtaattatcacatagattttcttttttttttttttgtcaggagtttaattcagaaaaagcatgatataaaagatgaagtcaagatgagcagcagttatttaaccacattagaacccaggcctgtagtttcttttgctagagacatttacataagcagacatcatctttaatctttgtttatattgtcacagtcttgtttttagtccttttgcctcttaaaactaagctgtcattattacttggacatttttactggcttattcattccagttgggatttccttccaaccttgcctgggaaatccagttactaatgcaactacagataacggtaagctcaacttccactacagtagccatttctgtttatcaatttctaatttgtgaaatacagagctgacgactggagatacataaatgaaggagtctcttactacctgatgcagagaactgtgctcacctgcattggtaggagttttaatttcaccattttcactagaaaattttcgcaacctactcatctgtcaaagggctaatatccagaatctacaatgaactcaaaaaaatttataagaaaaaaacaaacaactccatcaaaaagtgggtgaaggacatgaacagacacttctcaaaagaagacatttatgcagccaaaaaacacatgaaaaaatgctcaccatcactggccatcagagaaatgcaaatcaaaaccacggtgagatactatctcacaccagttagaatggcaatcattaaaaagtcaggaaacaacaggtgctggagaggatgtggagaaataggaacacttttacactgttggtgggactgtaaactaattcaaccattgtggaagtcggtgtggcgattcctcagggatctagaactagaaataccatttgacccagccatcccattactgggtatatacccaaaggactataaatcatgctgctataaagacacacgcacacttatgtttattgtggcactattcacaatagcaaagacttagaaccaacccaaatgtccaacaacgatagactggattaaggaaatgtggcacatatacaccatggaatactatgcagccataaaaaaggatgagttcatgtcctttgtagggacatggatgaaattggaaatcatcattctcagtaaactatcgcaaggacaaaaaaccaagcaccgcatgttctcactcataggtgggaattgaacaatgagaacacatggacacaggaaggggaacatcacaccctggggactgttgtgtggtggggggaggggggaggggggagggatagcattaggagatatacctaatgctaaatgatgagttaatgggtgcagcacaccagcatggcacatgtatacatatgtaactaacctgaatattgtgcacatgtaccctaaaagttaaagtataataataataaaataaaattaaaaaaaattatcacatagtttttcaatactaatgtcagtgtgttatgatgttttgtttagttgactggtgtgctagtacctattacatagatagcaatgcctagactaagaattaataagaagtgtctttctttagaaaatgagttaaagggtgacctttcaagcagattaattttaagaaaagtataagagaaattgaagctctgatattaatagcttaatattttctatatttatacgtcccagaaagtttttgaaatccccagaagtatgtaaaccccattctgaaaactcctgttgtcttgcacttgatagagtctgaaaatcaggctttcattttaagctgcttgtgatacccactgttgttttacaaatatttgtttaaaatccttaggtaaggtaagtcacttgagtaacggttggtttatgttatgtactttatgatgctcagccacaactttcagtgcaaaatagaatcacaaatatgcacttgcttaatcatcacttttaaaagcatgagtggaaagggtgaaaaaacacccccaaaaacacaaggaaatagaacgatgtagacatttttaaatagtaataccaaaacattttatattccaactttaaagcattataatttattttgaagaaaactataaattagattacaacacgtttctgaatataaagttagactgcaaattagtgggagtccttacatttaaattcaatttgtaacacagtcacatccccacgcatgcacttgctgcttccccatgggtatatatgtacatcctgaaaacgatatttttgtttacacttatatatatatatatatatgtgtatatatatatgtatatatatatatgtgtatatatatatgtatatatatatatgtgtatatatataatttaaagagctttattttgttttcccagttggatatttcttgagggctagtgtcacaactttttacaaaataagctacatgtagttttgaaaagagcaaacacttatgaatgttttttcattaaaaatacctacaagaaagaagaaacagaaatttggaaaaaaaacactatcaatctaacacttcagagatcactacatattgagcatccttaatctgaaatctaaaatcccaaatgctccatcccaaattcaaaactttttgaacactgacagaacaccacaagtgaaaaattccacagctggcctctcgtgacaggtcacagtcaaaatacagtcaaaattttgtttcatgtacaaaattatttaaaatattgtataaaattacctttaggctatatgtgtaaggtatgtatgaaacctaaataaatttcatgtttagctttgcatctcagtgttaagatatctcattatttatatataaacatttccaaaaatatacacaatctgaaactcttctggtcccaagcattttagataagggatgatcaatctgtccaaggttttttccgtagtttttgtcatttttatattatcttactaagtgtgttacatttcaacatctacctgtaaatagattccatattcttatacattcacttgatttattttgattttaattcattttaattttgatttttattcatacggtcaggataatctttattctcctaaactatacattgtattttacaacataaatgtgcttatcaagacttaacccctttgttgatacttagctaggcaagagtttcatctttataggtaaatccatttctccacattcttaataatttcatttgatttctaatttttctaactgcttataatttacaattctagtactatacagaatttagttgaatattctgaataattttagaaaaaaatcattctgtgaatattattgcagaatgcattaatctttttcatagccgataaatttccttatatccccatattactggctttatgtttcaatgtgtaatataaactaaactatttacacattctccataaagcttagaaataaacaacacaaaagtaagaacataatgtgtagctgatctgttatataggaatagttgaccttaacaatgtataataccttagaatttaaagaagatattgtgctataaaattgagaaaatatatatggtatttacaaatatgaccacatttcatactataggaagaaagaaaaaaaatcacctaaaataattactatatcacttctggtttcagcttcatgtaaaaaaaaagtgagtacccttttccttacaacaagaaatgggacaaactaaaagttaccagcttttcctaaacccataagagaactcaggtggcagaactgtccagtctgaaatttggagctacaggatcatccagtgagccttagctaagatctgcctatctggagcagatgctgctgaaatcataactggtaggaatatttaaatggtatgtttattgcggcactattcacaatagcaaagacttggaaccaagccaaatgtccaacaatgatagactggattaagaaaatgtggcacatatacaccatggaatactatgtagccataaaaaatgatgagttcatgtcctttgtaggggcatggatgaagctggaaaccatcattctcagcaaactattgcaaggacaaaaaaccaaacaccgcatgttctcactcataggtgggaattgaacaatgagaacacatggacacaggaaggggaacatcacacactggggcctgttgtggggtgggtgtacaggggagggatagcattaggagatatacctaatgttaaatgacgagttaatgggtgcagcacaccaacatggcacatgtgtacatatgtaactaacccgcacgatgtgcacatgtaccctaaaacttaaagtataaaaaaatggtaattttgatgaacagctgtaggatgaatgtatattcgtgttaaaataaaaaaaaaagtaacgcctgaggacagcagtctcagagttgtctccatatgcttgtggggctttacctccagaaaaaacaccagaggctcataaggaagatcctatatattcttctctatatctccagaaggaagagggtgagagtaatcattgtgaaatatatccgagccttctccacagcaaacatagtcttctggaggagaaaactttggcagtttaggcattgagggttatctcaattggaagaagttgaattatactacttcagccccttctattcttcctgtctcatgaaggcctaaacctcacaagtctaggcttgaaagtgaaggacagaggatactgcagccagggaacgaatttggaggaaggagagctaagctatttcatagggggcagaaacactttgaaggtcacagccccaagacataagaccattaaaagactgagatgtgatcagaaaattacagaacacttctcctttcccacagtttacaacgatatagtagggctccagtgtaaaagtagtggattatagctgaaaagaagtaagatacagcctctcttagaaaaaaagtacttagggaagttcaaagtcaagaaggaggacaaaaacaaggccattgggagaatgaaagacttctggaactgacagctaccacaaatattaaacacagcccaacgcttagcacactacaggcctgtttgcttcagcacttatcaccaaaacatcatatcttactttcaacaaaaatgttaccaagttggaaggcatgacaaaagcaagagagaacatagtctgaagagcaaaacaagcatctgaaccagattcagatatgacactcatgttagaattatcagtagagaatttaaaataactattatgaatatgttaaatgatttagtagaaaaaataattcaatatgcatgagtgaatgagcaatgtaagtagaaaggtgaaattctaaagaaaaatggtaagaaaatgctggaaatttaaaacactgtaatagaaatgaagaatacctttgagggcttatcaataaactcaacatagctgagaaaagaaagaatttaatttaaaataatcgaataaaaatttcctccccaaataaatgtaaaagagagaaaaaaacaaataacaacaaaaaaacagtgtatctaagaactgtagtccaataaaaggtataatatatcatcactgtaataccagaaggaaaagcaaagaacaatctggaggaaatatttgaagtaataatggccgagaccattttaaaattaatgacaaacaccaaacaacaaattcagtaagctcagagaacaccatgcaggataaatataagaaacaaagaaacataaatgccacaccaaggatatattgttttcaaaacttagaaaacaagaaacaaagagaaaattttgaaagacaggggaggtaagggatggtaggcatgtcacctacagaacagaaataggaattacagggaatttcttgctataagtcacgcaaagcaatgagagagtggaatgaattatttatcacattaaaagaaaaaaaccccaacaatttataattgtatatccagtgaaattattcttcaaaacagaaggataaagcctttctcaaggaaaaaatgaataaattcattaccagtaatctttccctgaaggagatgataagttttttagacataaggaaaattatgtaggtcagaaactcaggtacatagagaaaggaagacctttggaaatgaattaaatgaaataaaatcctttatttttcttattcctgaactaaacaaacactagctgtttagttgacctaaaacaactagtgtttgtttacaacattaataagtaagaatgtacaaataactactgtttgtttaaggcattaataataagaatgtactaagtaatgatagcatatggataagtgaaatgaatgacagtaatgtcacaaaagatagtggggaggaattggtaatattctatcacatggtatctgcagtacatgggaagtggtataatatcacttaagggtggacttagattatttaaaatgtaaattataactgtagggcaacagctaaaaaaagggaaataaaaatataatgttaagagaggaaatgaaatggaatcatataaaatgtgaaattaaaaccccagagggcagaaaaagagagaaaagaaacaaaagcaaacgcaatgaatatgtatcagttacaaacactataaatgtgaatggtctaaatatgccagttaaaagacagagattgttatagcacatacaaattatgaaccaattctatattgtctacgagaaatccactttaaatataaagacacagatgggttaaaagtaaaggaatatagaaagaaatgccatgttaacatgaattttaaaactgctgaagtacctagagtaatatcaaaattatgttagtaatatgttaacaatagatgttaaatgtggatctgtagtatcttcagaatttttctataaatctaaggctactcttaaacgaaatagttattttgagaaaaataacttcatcggaatcatgttcttaagcagtaagggcagtataatgcaatgttgaaagaaataatatccacatatttattgatacatggaaataaaactataaagaatattcttaaaataattaggcatagtttactttagaggccattctataatatgtatactttaaatgtttaatttcatcctctggatcttcttaggtcttggttccctagaatcagggacagaagaagaagttcctgtatgaattatttattaaggaagtgctatcatgcaaggaggtaatagaagcaaaaccaaatagaaaaggaagttgaacaaagaggtgtggctcagcctgattttacaggtatacctgtagtttgaatggctcttcacgattgttatgtctccatacaaagggtctggcttttatattcccacattagtcatgggcctcagtcctcactacccccaggatgtgcacattaggacaccaggaaaatcacttatatgggtatgtgttgcttttgttggcagaaagccatgataaatagtttcatgtaggctgtttaaatcatttgttgaaagttataaattagataaattaattttttaaaactttcttttcttttgctaatagcccacagtgtttttctataatttctatgtcctcagataacatggaaggctcacactatttcttgtttgtgtaaatgtttttccaaagcagactgcatagtgtacctagatattactttttctttattactctctagtgtctttaaacatcttaaagataggtccagagtctacaaaataggaaattaactggtagcctgactccagtggaattataaatcctcaatgcaaacatttctcttttttacaactttgttaatgatctgattttactccatattttcaaagctaaatcactactgttcaattaatttaaggcttttaaaatgcaaacgtatagttgtaagagaacagctgcactaaagtgctatttgcttaatctgcaaggctattgtttcagagacaccaagcattcaaacgaaacatacttcactaggaattatcaggagtaaaatgaagtgatgtttttctctacaaaatacaaaatagagtttaagtgtgatgctgtaaattgaggtataatgtaatcaattcatgaagtacacatagctgccttacatattttgtgtcaattgatggatttgtgttagaatgtagtactgtttacatgatagtacacaatgattggttatctagattaaatcatgggtatagtaaatctaaattaattattacctgaatcatagtcataaatttcattttattagaaataaacaggtttttaattaatgctttactcatagctcccttaagaataaatatggaatgaatggactgtttaaatgcatctatatatatatacatgtttatacttagcagttgaacacacatatatctctagatacatataatcataagttcaatatcttccatccttttaatcagttttccaaagacaaggatatagaaactattaaagtgaagaaaatatctatcaaagattagggaagcattacatgaagaaaattattttttgtttatctcctggaaataatacatttagagccaagttaatttattttattattgtatcacacacaaatataagccaagtttaatttaagaaagctaaacatcatattcctgtacctatatatttttaatgctgttcatattttacatatctttttatgaagaattgatacttgtccacaattctttaattattaacttatgagcttaagaatcttcaaaaggtaaactagttatctgcaaagaactattctgtctttaatcaaagatatatcaagtctctttgatctgattaacaatagtttggggaaaaaaaagaagtaaacctgcttctggtcggttgattaaagacactttctctatgttctatcatttcagagataaaaattctatttaattagtgatagatttcaacttaaattgaccaaaattcttcagctgaattagacaatagactagagaattttcacatacatttacatttgcattagttaaacattgtatttctcttgtgaaaacaatatgtttagttattcaataaagcaattttaagtcctaatacatttaaaagtaattgttatagttaatcaacatacactcaaatgactgaagaagaaagaatttaagagagaaaagatggtatattggcataatgaaccaggtatcttttgaatcacgtctaagtaacgatttttcaattaatgataattgttttaagatattaagctgttggtgtaaatatgtgactatatgcaataatactacctctatgtaaactatatgacatattataaattatacagcaaatgaatattttgttatgttctatttctatgtatttatagcagccattatggcataggatataatagaataattttttaaaatgagtccagaatttaccaaaatgttgactgattaccgaagaaaactgtgtccaaattattgagatttaatcatcttaaaagtaggttcagagtctacaagattgtgtttctttatgaagttttaattactttgatgtgattcatatgtaatattttcctttaagttttaaataatctgaaaaggtgggattgagaggattaagtttacttccagagtagtatatgcacttttttggtttgaaaaactctgaattaatataacttgcttagtctaagaggaacaccatggtagaaccaagatgagagtgcagtgccttacattctcagtgttattctcattctatagcactgaactagcaggagcaaatttcttcatttattagtctacattaccatacacataaatataaacatataaaacattgtgtaagtaatttttaaaaatctctttctccatccctacttttcactctctctctctctctctctcacacacacacacacacacacacactctgtcatgtcagaataatggaagtaaaattattagggaaaaccttaatatgtgactattaacccatcatgctggtcaaggggtcaaggctccacacagtatgcactttcaaatgagagttattcttttcactattacaggtatgtcctatattggagtcccacaaaagtgggttttgagacagaaaatttgaatgcaatttgggagcaatctgaaaaggcacctataggaagagggcaagtgaaacatggaagaacaggaaaggtatacagtttacattaataagcatatcgccattctgaacaatagactcttagaccctgtgaggacttacaggaaatgatttagatcatatctaagagtagtttgcttgagagatgaggaaactggtgtgtttatattccaattcccagtgatcatcatttgagaactgttctgcagaatcaccttttgtggtaattagttacaacaggagtaggaaactagcacaatgtcaaaaatatggttagttaagtgggaaaactgttggtagaatagtggtgttttgctttcgttatttttagaatgccatgctgtgacattcatatgaagaattaatatataaatttccttgtgcttagaaattccacatctagggaaatagggttaattgtgtatcataaggcatttacccagacattcactgaagcattcatcaacattatttattgaatgctgtgctagatattttcaatttgcttctctagatctccctctattgcatcaaagagctccctagttattcaccttctggttgaaaatgggagattgtaagttcggttatgtcatcagagagggaaagagagtgcagtcaaatgatgtattctctcctgactccctcattgcagaatttccctcatgacctagtacttaagccacaactccactgaaatggctttctctgtatcactcttttattccctctatttggcccttcaaggaataataatttaggtgtgcgttccatttcttgttacccatgacacaggctgatactagagctcactagatggcaggtattttcctagttgctaccattatatcactcatttagctcacattctagttggcaagtagaacaacacaaacataaatgagtaaaacatatgaatttataggagaaaaagtaaaggtaaaaataattgaagtttcaagagagagactgttggatttgaccaggggagtatatttaaaaagatttgaggggtcatctgtgataatctgggtagatgtgtgtatgcaggagagcattccaggtagaggggtcattaagaacaaagaccctgagatagaattgtgcctactgtgtttgagcaataatgaagagaccaatggaactggagaggagtgatcaaaagggagaatacacggaagatgcagtcacagagatggacagttcttatagaatttggtaagctattgtaaggaatttgccattcaatctgagcaaaatcagtggttagtgcaggtattttaggagggaagcgaaataatgtgtcttatattttaatagaattactctttctgccatgttaaaaatagagtgaagtggagtgagatccgaagctggaagtacagttaggaggccgtcccgaacatggtggtaaacagatgtcaaggatgttgaccctggggaatgggttggagatacagaaagcctgtttatttctggatgcttttcaatgttgaaccaataaaatatctgtctttctttttctttttcttttttttcttttttttttttttgagacagagtctcacactgttgcccaggctggagtgcagcggtgcgatctcggctcactgcaagctccacctcccgggttcacgccattctcctgcctcagcctcccgagtagctgggactacaggcgcccgctaccacaccgggatattttttttttttttgtatttttagtagaggcggggtttcaccctgttagccaggatggtcttggtctcctgacttcgtgatcctcccgcctcagcctcccaaagtgcggggattacaggcgtgagccacctgacaaatgtgagaaaaaaataattaaggatttccatattcccagctactgaggaggctgatgagggaggattacctgaacccaggagtttcagattgtggtgagatatgatcgcacccctgcactccagcctgggcaacaaagcaagaccttatctcacaaaaaattaaataagtaaaatcgttaaggataactccaagatattttgatcagagtaactgagaagttctgactttactgaaatgggaaagactgtggtaaagctagtttgtgcagatatttcgagagattacttttggatgtgttgaatgtgatgtgtctactatacatcaaagaggacactttgagtagcgagtacggaatatggattctatctcagaggagaaaactatacaggataaataaacttgggatttatcaccatattgggatttaaagctgtgagaatagttaagatcagctaaggattttgtatacgtatataaaagaaaaacagtaagatgactgggctttgcctggatctgttcaccatttaaatgcttgctttgttagagaaaaataaatgacaaaaaccgactttggacaaacagccaatgaacacaaaaatcaagtgatgctgttgtaacataagcaaataaagggagtgtttccaaaaggatggaatgcccaatgttattagtggcctaaataagatcaggacttggaattaatgattctaattattaagatggaagatattggggatcttggaagagttgaggggtgaaaaatctgattggatgaattcaagaaagaatagagaaaaacatattttcaacgagctagaatgaagacatggagaagggaggggagttgttttgctttgtgtcatatctaatatggaaaagaaataactgggtacttctatgctgaatagaatggtatgtaatagaggaaaaaatattgacacatgagataaaagaattgccaaattcatttgtctctgactatccaaaagaaggtatagtttaatgcaaaaaagaaaatattgtccttagctaggagcaaggagagttcagctgtctaagaggagaatagcttgtgcaggcacacatgagtggaaggtgcagatttgcagaatttcttatataggttattttgttttctcacagggggaaaaagtaggcagtggagtgtgagtgtaggaaatgagatagtcaaggattttgaagaaagaaggtaatataaggagacagacatttcagagacaagtagaatgaatgaagttaaatatggttgtctaaaaatccaatagcccagtaaatttagtaatcatatgtccaaagtgacattactccacaaacgtgcttgtttgtgagtttatgtgctcttttgtgtgtgtgtgtgtgtgtgtgtgtgcatgctacctaccctcagctgcacttgtatggaccttgagaaattgaataattaaatttattgagagttgttattttagaaaatgcacgtgatgagataaaagtggtgaaaatttttagggtatttgtttgggtgtgattacaaaatagatttttatatatcagtaacttgtatggccttaccatataccaggcactattctaagttatttacaattattcactcattgaaatatcataacagccctgtgaggcagatattataattttcccatttttatcagtgaggacactgaggcatagaagggttaggaaatttgactaatgcgtaagcacttttaaaggatagacttaaatctccaaccctggcaatctgtgtctacagctcatgcccttaaggaatttgagcaggatacaaagagaggaaagtacatgaagtgggaagtaaaataataaaccttacaagaaactgggatactagatggagtaagtgggaaaggaaccaagatggtggacttcggtcactttcttacatatctttgaaagcgtatttactaattatgccatgtgcatgttcagaatgctttcttcatacaaaatctacttatgtttagaaaaagtatttatgagtttctagattaataattatttttcagtttttgatctgtttggttgcacaaatatgtttacttcatgataatttatatcaagaaatttgcatgtaatttatatcagtaaagtaaattagtagttaaatcaataatttatattaataaattatcatgaaatgattatcaaaaactaaaaattatcattaatacagaaaaatcctttaggcaaatgtccagtcactaccaccatcctttattccatgattagccctattctgcttctaacacaataatttttattgcttaatttttaacttcatatagatataatcgtacttaatcttaaatttgagaaatgtgttcatgctattagaactagcaataattcatttatgtctttgtatagcattacattttaagaatataccacaagtatttatctatactattattgatagacaatttggttattgccagttattagctactttaaattgtgctgttattcatactgtcataggtgttttaactacatatttgcctatggaatttcaatgtaattacctaatgttacaaataaataggattctattacatatctactctgcaaatgttgtattagtgttcttttacattatgtcgcattttttcctccagttatttgtactttgacaggttagaggtgttttggctttgaaaaaatgtttcatggaagttgcagaaatctttcaaaatcacatttattcatgatcagaaacaccatgtcttatagcaaatttatctaatcattttcttttaaatatgcttcatcccaaaatacagattagtataattctagctttatagaagagtttgaaatttttctttctttattctctagaaaagtttaaatactattagaataatttgttctttttagattagataattaaactgtgaaattttctgggaattatctttattaagtgcttagactttgacaacttttataattattttataataattggtctattgagattttatgtatgtctctgagagttggtggcagccattgcatttttataaaaatcaattccatagaggtttttgaatttgattaaaatattcttttagctatttacagctttctctctgttctattttcataaacaatttataaatttgtatctttaccttcttgtgattttattgcttataacagctcactatcttttaattatatttttcaaaaatctaactccttactttgtttgttaaatctaattttcctcagtaatataagttatttctgcagttatatttattaaactcagtccatttctctttttaacttactaaatttaatgcttactaaaaatccctgggtgctgaacttaaggattggtttttattatcattatttttatttattttttcattcttcccaaacagttgttttggagaaacttttaaaatgccctaatttgtggagtttattttttttcttctactttaaagagacagcttttattttttcattatgaacagagaatatgatagttcttagctttgaaaatttattgagattttccctatggtaaaatttattgagatttttcctatggtaggccatataattactttttataaacatttgattcatatattataagaatataaatgagtagatattgattgattaactgatgaattcaacatatacttactgaatattcagtatgtctttggcacctggaactgattaaaaaaaaaagaagcaagcatttctgccttcttgaatttcacactatagctggagaaggaataaaataaaccatgcacattgtacttaagtacataatgctatctctttttaatatgataaatgctttgagagaaataaacaaaaagaacagtaatgaagggtagagagcaagagtttaaattttatatgtgaaggtttgggaaagaaattgagaaagtgttacttgaataaagacttgaagaaggttgaaaagagaccccttttcatatctagaggaaagagcatttcatgcagagcacacagccagagcaaaggctgtcaggtatgtgagtgtgcacctagtatagtctagaaagaacaaaaaaggatagtgtggccggagaagagtgagagaaggggtgcaattggaaagaataacgtcagaactgtaatgaggtcattgtaaggactttgaattgtagtccaacagtagcaggaagcactggaggcttttgaggagaacaatggtgtgattatataaatgtaataactatagtattaaaagacccgatccaacagatctgtggtgaacagaatggctgcatgcagtacttctgatgagagattgtcttggctaagagtaggattgtagcaataaagaattggctaaattttggatatttttcaaagtagatccttcataaagaatttctttctacagtgcttgtgggaaatgaaggaaatacataaaaaaggaaatccctattgtggcctgagcaactagaaatagagagtccctcagacaaaaaggtcttataatgaaataaatatggggagggggatccagaattcagccctggatttgttcagtttgaggtgtctactagatatttaagtgaagccagatacgcaattagatgttggagtttaataattagctatacaagtgatttaaaaacacaaggcaggaagctattaatgacggtacgagtaaagacagagaaaataacagactcgaggattgatataataatatcataagggtggagaaagatcaggaatcaggaatcagaagaaatgaggagagtagtacaaatgaaacaagaaaggaggagagtgcctgatttaaattggtttaagaaaaaatgggagaacagggttggcgacagtgaatatacttccacagtttttgttttaaaggagattcatgtgttgtataagatccaccagagaaagagatgtaccacctctcccttctcagttttggtgttgccacatgcacagtaggtaggagatggatttgccttatgttggtggctataaaccccaggcttgatgactctggtctagtctttatctgtggattagttgacatctgtcagcagctaggaagttgacaatcattttctccctttcttttctcactaactgttttaaggtgctctctgtacgaaatagggttaggcatatttatgcaatttcttcttcagctccttcattcaaaagcattacaaaaatataaggttaaaaataaggtacataaacaaataaaatttgaaattaaaaacagattagcaataaaaaagtactacttaggtataaccctatctatctatctatcatctatctatctatcatctatcatctatctatctatctatctatctatctatctatctatctatctatagatagatatgacctatatgagaaaaactataaaactctgatgaaagaaatcaaaggactaaataaatggagaccaatattggacaggtgtcagttattctcagcttgatctatagattcaatgaaaccctaatcaaattccaagttattttgtggatatggacacacttcttggaaagcttacatggagagaaataagatccagaatagccaacacaacagtcaaggagaaggacaaaattggaggactgccattactgacttaaagacatattataaggctacaataatcatgacagtgcagttttgacgaaagaatagacaaatacatcaatggaagagaataaagagcccagaaatgggagcatgtaatattgtcaacagatctatgacaaaggggcaaagacaatacaatggggcaaagatagtttttccaacaaatagttctagaacaaccgaacatccacatgcaaaaataaatgaatttagacatagaaacttcacaaaatttaatttaaaataaatcacatatctaaagttaaacacaaaacttttaaaaactcctaagaatataaccgaaaaatatctacatgatcttagacttcataattgtacaccacaggcataatccatgaaacaaagaactagtaagctggacttcaataaagttaaaattttctgctgtatgaaagacactgtccagataattagaaggcaagccacagatgaaaagacaatatttataagacatatcaaataaagattgttatccaaaatatacagtaaattctattttttaaatttttaattaaaaataataatcatatatttatatggtataacatgatattttgctttatgaaagctaattataaccatcactagaagatggagtgagtgcttgtgagttggtgtgatcctctgactttaaacattctgttactatatatattttttaaggatcatgctttaataatttgtaaaaataacagtgaaaaattggtaacttgtatttaaagtattttacttttggttacaactcagactgttttaggatataattttggaagacttgccttttttaaaacttcaacttttattttagatacagggatgcttgtgcagatttgttacatgggtaaattacacccaagtaatgaacatagtacccaataggtagtttttcaacctacctccctatctccaaccctccagtaatccacagtgtctaccattttcttatttgtgtccatgtgtgctcaatgtttaggtcacacctaaaagtgagaagatgcagtatttgattttctcttcctacattaatttgcttaggactgtggccccctgctctatccatgtttttgtgctgcagaggacattgtttcattctttttctggctctgttgtattccatggtgtatatgaactacgtatgctttatcaaatccaccattaatgggcacctaggttaattctatgcctttgctattgtgaatagattggtgatgaatgaaaccaaaagttgattattaaaaaaaaaaaaaaaaaaaaaaaaaaaaacaagtgtaaggaaaatggctgggcttcagtcaggagtaggctgaggcagacatccggtgcagcatgacacagaggctttggggcccggcacacaaccccgtgcactatgtcatcatgtttatgtagccattttgatgtaacctgtttttgtgagctcatacctggctttcagcgactgttgtctgtgaaaaatataactgcactgctgactctgtagtagggagagagatgaataaagccatgtcccacctacggtccctcgagggtcttttcagctacccaccacctgtccaccaactcccctccgaccccagctcaggttgaaacctgacaattggtgtagttggcaggatcccaaggtgagacagcccttagtccccgatgatcccggtcagccatgtggccccagcatgggttgtggtacccgctggcagccgtgctgctaggatgggccctggtggataggtcccccatgagcagggagaaggcgcagaagcacctggaagcacagaacactgagggagcggcgcctttgccagtagagttggatggacgattttggctgcgctatgggaagtacaagctcagtctctgcgggatgcagcgcaggtaagggacctccaggcacaagcagagaacctggaggcctggatacacagcttggaatgggaattaggggctgccgttagtcgggcctgggcccaccatccaggtcagagaccctcgctcggtctgataccaaggaggaaggacaccctgttgtgggctcgcccagtggtccatcagaaaatagagcatgaacagcctttggggccccaggggcgggctcagggaccccctaccatgacagagcacatgtcacacagtgcctatatcccaactgagttgcaggaattaggtaaacagtgccggcagcacgtgggggaacccctacctgcctggatgctgcgcctatgggatgagggagccaacagcattgtctgctccacctctgaaatggaaaagttggcctccattacgacccattcctccctccatcggcgattgcagttcagcaggcagttaccataggggcaaggtgactacaccctaattgaatgactgatggtggccatacgaaccgtatggaatgatgccggagaaataccagaagctgactaaatgagtcatatataaatttggtgcaaataatttgggagacgggtatatggcaggctatgctggatctgaatacccaagggccagatgatgaacgctttacctcccacgtgagggaccttgtgttagggtctccgcctccgagtgtcttcggctccttggccactgtcctcactccatgcatggggtgccacatacatgtgggtactactgccgtggcggcccacagggaagcagagggctgttggggggaccggggagtccctgccataaaaagggggcaggcagcccttccacaggaccccacctcatgggacaaaaaggggccccaacaggtgactcacatgcagatgtggactgatgattttggctggggttgccggagagaaaattgataggtaacccgataaagccctgttaactttgtggaggcagttgtcctaggagcaacaattctagaaaattctcaagagggggcaggacaatgctgctcgacccagtcccgcacagacgcgccagctcaaggactactggcagacgggaggaggtatagagccctttgtgtttgcttagggaactggctgaggtgcccggcttggggtgcctcctaacgaccgaaggccacatgtggaattggcaatccactggttccccagcaaggaacagtgtgtgctggtcctggtagacaccagtgcagatcgcagcctcatctatgggaacccggataagtttctgggcaaggctgtatgtatagacggctgtggaggctggtcattgagaatgaaacctgtatctttgcaccttggcactggccacttggctccctgcttatacaccgcatatgtctctcccatacctgaatacgttctgggggtggatattttacacagcttggcttcacaaaccacggccggataattcagacgccaactatgtgtggttaagccagtactgcgctgacatacgggcatcacccgccccaggtcctgccacaaccccgacgggttaattccacctgtcaataccacttggctggtgggcagatggagataactgagactattcataagttagtgaaggtgcagatagtgcgtggcatgcacagcccttacgattctccagtatggccagtcagcaagcctgatggaccttggtgggtgacgttggattactgagaactaaataaagtaacaccccttttacatgcagctgtgccttctatcacggatttgatggaccacttgacaatggaattgggacagcaccactatgtggtgaacttggccaatgcattcttctcaattgacattgctccagagagccaggaagtttgccttcatgtgggaggggtgacaatagactttgacggtgttgctgcagggctatgtgcatagccacgtcatatgtcatggtctccttgccacggatttagtgacctggaaatgtccaaagggggtccacttattccattatattgattatgttatgttaacctctgattctcttggagatttagaagcagcagcatccctcctgtgacaacatttggcagtatgcggttgggctgtcaacaaatcaatgtccaaagacctgattgtctgccaaattcttgggagttatctggttgaataagacaaaggccataccagaggccatcactgataaaattcaggcatatccccggcccacaacgatgtggcagctacagacttttgtgtgccttttgggatattggcaagcatcgcaccctatttggctcagttgatgaaacacttgcattggttgacaaaaaaaggaactacctggaattgggctgatgaggctgagatggcttttctggcagccaagcaggccatacagcaagcacaggccctatgagtgattgacctggggcgcccatttgaaatggatgagcatgtgaccacagatgactgtggctggggcctatggcagtccatggagcacttcagaacactggtagacttttggtcccagctttggaagggaggtgagctccgatagtcactgatagagaagtagttagcagcttcatatgctgcccttcagtcttgtgagagtgtgatgggatgggctgaagtcatcgtgtggatgacttacccaatagtggggtgggtacattcaatgaccccccagacaggacagcacagacatccaccttagcaaagtggggtgcctacttagaacagcagaataccctgagtataagccccttagcagcagaattataagaagtcaggggacctgtagtcctgatgcatgataaggccatggatcagcctgaggcacccttaaaccctgagccatcagcatttagaagggcactcctccattcccaatggggcatggtatacagatgggtccagctggagtgttactgctgcctggaccattgtcatggtccagcctattactgataccatatggtttgatactgggtgtggacaaagcagccaatgagctgaacttagggcattgtggatggtgatcaccaaggaagagacacctaggctaatctgcaccaatagccgggcagtttgtagaggcctaaccttgcagttaacgacctggaagttacagaattggctagttggccaccaggccatttgggaccaggccatatggcaagacctatgggaaatgggtgtaaccaagggatcacccataaatcaccaaaaggatgtaactatttatcatgtgtcaggccatgtgcctttggctgcccctggcaatgataaggcaggtgccttagccaaggtccaatggttggagtcagcacttacatgatatgtagccccatgactgcaccgaaaattgggtcgtgcaaggcgtaaactaatgcaacaggtcaagaagcattgggatctgtccatgtccaagcaagatatctgggaggcctgccggaagtgcccagtgtgtgcaccggcatacccccaggtggagacagctagctgcccagtgttacacaacaaatgacagtagggtggatgcccttgattaggtggcaaacagaccacatcaggccgctgccaaggtcgcgggggcatacgcatgtgctgacagctgtagacacggccaccagtctgttgtttgcctacacttgcaggatggctgaccaatagcataccattcaggccctgcaacagttgtgtgccctatacggtcaccccctgaccattgaaagtgataggggaacacattttaccggacagcaggtacaagagcgggtgcaatggatggacataaagtagaggttccatattccatataactcacaacccactggcatgattgagtgatttaacggactcctgaaaaatgggttacagttgcatgttactcccccttctttacagggctggagttcaaggttggacctcatgctctaaaacatgaatgaatggctacggaaaggtggcccagacccggtggagtcactgtgacactgggccactgctcccatcctgttacagatacacactaaggaggacctcttccaaccaggtatgaggacgaatggtaatctgttgttgcctgccccaatgcccctaaaggcatgggaacaaaaagcctggctttggccatggaccctcatagcctcccattgccaatggttggctatcatagacccctggggggagtgcgtacagtatgatttacatgtcactccttaggtatttaatatatgacctctacaattgaccattcatagggaaatgaccagggaaggaacccttctccaggggacatatgtattgtttgtgcagcctattatgagctccccagtgactttggaatggatacaggacccaaacgaacaatggggagctgaaaaggtatggtaccatcgctcagggcagaagcccttggcagctgcattgttatccagagatgaaaggttggcctgtattttgcctgaggggtgtgatatacccgtcagtaccggtgcctgctttgtcgtttcaaccataggttgacatgctccaacagcattgtggactgggcccacacctatgctgaggtgaccaatgtttccaactgttggatctacactgcccttctagcagcagctctggacagcttgcccttgcacatacatccagcttctgcggaaaactggacatggttagagacttagggtactatggccaacgtttggaacatgacacagcaagcttcggataggaggtgctgcaaaacccatggcatgcctgcctcccggctgacctatagcatctatgatggatggggctggttagttggagaacacttggtgcccccactacaggtaccatgatggatggagcaacattggggtaatgtcacgcatagcctgcactaatataacatatgtcaccacaccaaaggcgtggtggaataggtggcctcatcaaggctgggccctaatggactttgtgccccctggagtttataggtgtgtggagacatgggatcatcatacttaccagtgaactggactgactgctgtactggggggcggccttatgtgcctgtcactgttattccaacattgcctagacacccacataactgggaggtgctacagtccctgtttttgcgagtgcgacgagctcccggtggctctacaccttagcattaatcatccctggagcaggtgtcagaactgtagaaatgcaagttacggcccttgcggagcacactactggagtcttgaattacaccctagttgccctccttctgtagacagatgaggctgatcaaaccagtaggtggtactgcagaaccagatggccctagacatattaactgctgcccaaggtggcacctgtgctcttttgggaatgcaatgttttaccttcatccatgacaatcaacaaaacataacagtagctttgcaaggagtttcccagaaaatcaaggcagttgagagccttactgatgaccccttacagacatggtaggcatctctgggctctggcttatattgcaccctaataattatgggcagcatagtgggaatattactagtgagctgttgctccctgtattgctgctgtggcctctgggtccaaggttctgccctgtgggcaagtctccccactaggagaactcccttggcctagggagtggagtgtaaggaaaatgggtgtgcttcagtcaggagtaggtggaggcagacatcggtacaccatgacacagcgctggtgcaacaccctgtgcattacgtaatcacatttatgtagccattttgatgtaacctgtttttgtgagctcatacctggctttgagccactgttgtctgtgaaaaatataaccgcattgctgactctgtaggagaccatttcccacctgcctatggtcccctgagtgttctttcagctacccgccacccgtccaccgactcccctcggaccccagcttgggttgcaacctgacagcaaggttgatagactgctagctagtgtaacaaagacaaaagagaagatccacataagtacaatcagaaatgacaaaatgacattacatctgatcccacagagtttcataagatcctcagagactattatgaacaagtctatgcacacaaattagaatatctagaggaaatgaataaattcctggaagcacacactctcccaagattgaatcaagaagagattgaaaccatgagtagaccaatatagggctctgacaattgaatcggcaataaattcttaaaagtcaacaataagtaaattaaaaacctgatttaaaaatgggtgaaggaccttaacagacacatcacaaatgaaaatacataaatgacagataagcatatgaaaagttgttccactttatatgtcattagagaaatgtaaatttaaatgacagcgagatacagccacatacctcttagaatggccaatatccagaacactgacagcaccaaacgctggtgaggaggtgaagcaacaataactctcattcattgctgacacaaaggcaaaatggtagacactttggaattcaatatgacagtttcttatgagacaaaactactcttgccatgtgatctagcaatcacacatctcggtatttacccaaataagttgaaaacttacatccacacaaaaacctacacaaagttgtttacaacagctttattcatgattgtcaaaacttcaaagcaaccaagatatcctttactagatgatgagaaaaataaactggtaccacctgacaatggaatataattgaacaataaaaagaaatgagctaccgagccatgaaaagatatggcggtaacttaaacgcacataactaagcgaaagaagccaatctgaaagggcacaggctatgtaattccaactatctgacactctatggcaaaactatggagacagtaaaaaggtcagtggttgtcaggggttagaggtggggggaaggataaataggtggaatacaaaggatttttaaggcagttttaaactattctgtacgatattacaatggcggttacgtcattatacttttcttctgaacccgtagaatatataatatggacagtgaaccctattgttaactatggactttgagtgataatgatgtgtcagtgtaggtccaccaattctaacaactggaccactcaggtgggggatattgataatggagtctatgcctgtgtaagagcaggtagtatataggaaatctctgtattttctgttcagttttgctgtgaacataaaactgctgtaaaaaggtctcttaaaaataaggtacaaaccatatcagttttgtgatttacagagatttgttatctgaaactaattcacaacatatttatctgttacatcatttagtgagtcaacttttcggataagaatcttagctaaaacatgcggtgtttggttttttgtccttgcgatagtttgctgacacaggaaggggaacatcacacaccggggcctgttgtagggtcggaggaggtggggagggatagcattaggagatatacctaatgttaaatgacgagttaatgggtgcagcacaccaacatggcacatgtatatatatgtaacaaacctgcacgttgtgcacatgtaccctaaaacttaaagtataataataacccccccacaaaaaaaaatcttagctaaaactgagaggaaaaacattttgtcacttaatccataggaataacagaaatacaaggaattaattgtttatatcatcacaataaattcttaacaagaaaatgtagtattaaaaaaataaccaaattagaatgaatggcacttttaaaataatgtaatatagctagaaaaaaatagtgtatttttttaacaattccaatgatactaagtaataaattctagcccagattttttttatagcaagttaatttaggacctagttacatatttctcttcctcctggttggggtaaaaatttaagcttaatgctgcccaatcaatatttcaaaaagcttgtcttgatcatcttcttttaattacataataaagtgcttctaaaattactctttcagtggaagcaattggtttatatatttaaatgtctgtcatggcatataaaggatcaggtgcactcttcaaaaagaaaaaatatctttcctcgtattctgttatattgtccttttactttttaaaaaattgtcatattatttgctgcctttgaacttatcaaaaataagtaacatatctttagaaaataagtaactcctataattttaaagggcattgcaggagtgagaataaagctttacacatttttaactcttctctaacatttggcaatcaatgcgagctgtattagtccagcttgtaaggtggaagctgtaactgtaacttccaggctagtcacatagttcccctgaggtcaataaccttttaacacatctacaggttggtggtgtaaaataacagctctttgatttttaacaaaatatggaatgattcattcaataatacactgaaattttattgagtctatgtgtatgatggaatttttggggatcttacaatttaacagtaaataaaaagttttaaaaaagaatccttcaattgagatatagagagggaagatgaacggtaaagaataaagaattaataggtgaaaataaggcttactagaggacaataagtgctatgcaaattttttaaaaagaggtagacggttggtgggtaggtgtcaatgctaaatagggtggctggaagaggccccagagagaagaagtaacgagcagataccatcatgggaaatgacctttctggtagggagccatatgctggaagaacaaagacgttcttctaatgtgaagagaaaaatatagtggaaatcactgaatatgtgtctccatgttctttggtccaacagggttatagaagcagtgctcagtagccaattaggagaataaaagggcaaggaattgcagagagaaataatatgatgagagaaattttgccttgaggttttcaggtccctggtataagcaacacacagacaaatattgggcccacttagcgtaattagactaattaaaagcaattaacccatcctccacctacaaaatgaagaagtttagagctgcagctcagcttagatatgtatgcttctggttgaaaaaacccttcagctaatttgtcctgctgctgtgttaattgaaactcagttgattgaaaaaaaaaaaaaaaaaaacttggaaaagaaaagcccttcatctaaaaagagagtcatttattctgacaattacaattattgaaatgttcttttctatacctatatgacaggaatattatgctgctaagcatatacgcatccacagacacataggcccaccaaaatacacagaatttctcttaaaagattagagtggtatttttaatagaaaaagaagacccataggatgtaagctttgaagtaaattaagatttgcctttaccatattggaaaataaagttgtgattggaagacttgattttagtgggttaagaaaagaagtattttattcagaatattttacatataaagatttgtgcccatatacacacaaacattcacagaacatatatacagtatcattatcagaggctgagctctgaaatatttttattttctgtgtgataatgtatgaaggaatgagttaccatcattctaattttattaagtaagctttatcaatttctatacacaaaaatacacacatatgcagacacatagggttcaaatataatctgtatttctataaattttgctttataaaatgccccttttaaatcttgctctattgtgaagttgacagggagtctttaaaatgattataattaattctagtgttatatgcttaactgatagatatgttaagtatcatagaggaataacatccaccatatagctgcaaaaagaattttagaagtttggccagtttacaaaagaaaaggattctaagaaaagcaggctaatgaatagaataaacttagtccaaaatatcatacattaacaataaaattttaagcaagtattaattttttcaaagaaatcaatatgacatatttaggagttcattacagaggagggtgaataataaacctggaaagaaaaagcatgaatatatctttataaaatcaaaagaatatttgctactactctgtttaccattgtgctaaatgtagcatgtagcatcttgtcttatctttatctctttaatatcagtatttaagctaagcaaacagattgcattttagaataaataataaaattatctctgtatgtgtgttggtttttttctttttgttctttgcttatggccagtctttttaaaaatccatttcctatagtataaacagaaggatgtatttaaatcatggattattcttactatttaaaaatactgctattttattgtgaaaagagcagtactaggattgagaaatgataaaactatgaaaattatcgtgttaatgtaaaatccagttggtttcactaaaatgaaataaaacccaaaacctgttttattgattcacacaaaactttataaattattacctacccttagagattttggaacattataaaacagacttagtttccccctatgaatgtgaaagaaaatggaaaaataatcatctcatgagaaaatggctttgaaacaagagtaacttctataagaaaacagctgtttcaagcacaattatttacagatttttttcttggacaaataatttcttaaaacatcattatatcagagattacaatgttcaattaagcctggaaagaaagcactgtatgaggagatataaatgtccagattgcatcttaccctctgcccggaaaagctaatgtactgagaacagcaggtttttgcaatagagaaagaatgtaataaatatacagccaactaagtgagaggacaggagtttatttttactcaaattagcctccttgagaattttgaggctagagatttttaagaataatttggcagatgggggttgggattagagaatccttatttgtcgggttgggatgaaatcatagggagtaataacttgtcttcttgcactgaatcagttcctgaatggggccagcaagaccagatgagcctgtttaccagtctcagtggtgccagctggtccaccagaatgcagggtctgaaaaatacctcaaaccctaatctcaggtttacaatagtgatgttatctataggagcaattagggagtttaggaactgtgcggcctctggctgcatgactcctgagccataatttatattcttgtggataatttattagttttatacatgcagtttgatcaccaagcaccgagggagtttgttgcaagaataggctgttaccttctttctttcaaagttaaactatgaactaaattccttccaaagctagcttgacctatgcccaggcatgaacaagggcagcttggaggcaagaagcaagatagagccagttatgtcagatttctttcactgtcataaatttcccttgtcagatttatctcactgtcataattttgcaaaaacagtatcagggatatctttccataaacaacatatagttttatgattaatagaacccaattatactgaaggcaaaataatagattattgtaaacttcattattaataaaagagtcaattattgaacatataatataatggaaaatttagaaacatcctatttgtgaacttagtatgtagaaatttttttctgtatctgtggaagaaatgtaataaaccaagttattccatttaacccaatgaatttaaaagaaaaaatttgttttggacatactattgctttaattacattttgatatcatttcaggtatggaaatgaattggctactatatgatgctatttgaaatgtatgtatttataatttgtttgaaagcttagtatttcagtgtctctcaaaatagtaaagatgttcggccgtttgcggtggctcacgcttgtaatcccagcattttgggaggctgaggcaggtggtaatgaggtcaggagatcaagaccatcctggccaacatggtttagtagaaaccccgtctatactaaaaatacaaaaattaggcagcatggtggcacgcccctgtagtcccagctactcgggaggctgaggcaggagaatcacttgaacctgggaggcagaggctgcagtgagccgagatcatgccactgtactccagcttgggtgacagagagagactccgtctcaaaaaaaaagttattcattctgtatgatctacattgtactttaaaaatatgtcatatggatattactataaaattagaaatattgtgtgcatactccttgtacatcactgttttatccaaaaagcccacagattacagaactccattattagggtactgaaccttcttgatttctctaattctcggtttgtaatatcagaattagctactacatgggaaatgaaaatgtatgtagtaacttggcatttctagacagctattctacttggagattaatgctttacttccctcccatttttctctcttcctgttccagcaagaggcagcagaaaatcaccttggttgtccaaggaagattaatagtctttcaatctgatggtaagtcaggtcttacccaccaaggaagggagaaacacagtattagcacacggcagaaaaaaagacaagcaaataatatgtctactcttgataaagaagattttgatacattcacagagcgagaaaaaagttagtaataactgctgtgacagttaatgcatccagtatgtttatataaaatgtatgaagaatatcggtattaaaaaaataaaaaagcaaaatgtaacagtactaggagaactttaagatagcattctcactcatttgtttagaaattcaaatgataaacaagaatcgagaatatctgaataatattttatagccattagaatatgcatgtatgtgtatatatgtatacacatacacaaacacacattaacatgtttatatgtatatatatgcagtaacacgtgtttgtgtgtgagtgcatgtatatacatctccacaaaactttcatacaattcaatgatggtttgtcttctagctacgaaacatcaaaaatagatgatcaattttaccatatatgaaatttcacaaaacaataaaatttgaaaccattaagaaaaggccatttaaataaattaaacaattagaaattaaatgccaaacaaaacactctcctaggcagtttgctttcctaacagcttactaagctgcaattactcacttttcaaaagcccaagtaaaataattacactatacataatatttctgacatggccaatgctgaaagtaaaggaacatttgcagccctaaaatacttgtattattttactagagagaaaaataagtgaatcaatcatttaaataaggttataaaaataaccacataataaattaattataaataattaaaaaagaaatcaatttaatccaagtgattttttaaatacttaatatctttaaagataattgttacaaatggaagaaaagcaaaatatttgtcacaataataaatttatgaacacagatatggaggcatgcttccattttctgaacttcccttgacttttgcctgttgtatatgttaagcatgcatgcagtaagatagcaaaacagaaacaacagcatttcctgccctattacgctctcagaagtattagccttcagcgtgtattaagcccataggtcatactggtaaattgttttgaatgacaaagctacataattcggctaatagggatatcacagcagtgagcagaacatcggtgcatcacataaaaagggacattctctcagtgtgtccttttggtgctgtcaacacataatttgactaaaaatcgtccacccagtctttcaactgtagtgtaactaattttgcataataagtaaccaggaagaaataattagagattattatataaaaaccctgtttcctttcaacatttgacccactagctttaatagtcttcgtagattcttttctgagtcaagtctttgaatgttgcacatggtgattttccaactttattattccttctatatagtatttataggttggaattctactttaagaaagaaatctcctttcctcctctattcatttgttcatttattacctgatgaacacacagatttttatgttattcaatagactacaggttcattaatattattttactttgattttttttgtactatatttggacaaagaaaccaattcaaaatagctctgttattacatttggtatgaccagcacctttgttaagccagatttattgtttctcctggtattcaaagacataacagaattgaaataagttttggattttgcttacacaagaatcacgctctcattatttactttaaatgtactttactagtcaggactacataataacattggggttggaaacagaaactttgtccaaagtaaacttgaaagtttctgagctattacaagccaaggctcaatatgagcacatattcatgtgtgagaggctcactgtacagtaacattctgtatagaatacagtcaatatttattaaatagacaagcttttatttaaaaattaaaatatgccctaatttgcatatatgtaaatatttatatatattggaaatctacaccagtaactgccatgattgtttagaatatagattcactaatttgttttttaggaaggagtattttatcactgatgtttaaaatcgccaacaaataccgatagtaaaaagcaggtcatcttttcactaattttaaatattagttttacattttagataacacagttccttattttctatactcaggacagcccatttccatttgtcagattcgatatgccacactctgaccaaactttttttatccattatcatgacctttgattgtttttagtaaatgcttctgcactcagcattaatttatctagctaatactaatttttaggagtactaagcaagtgactttccaatttagttttactgatgagtacagggcaaatgtagccaaataagaccaaaagtaaaatagtaaacatcccttttaaggaataggaggaatattgtattattttgcaattacattttaaggttgaaattagtggaggatttctctgcatcagacgtttatatgttcaagagattatttcttacgtaaatgaagaaataaggacacaaaaataaaaaataagctagagaaaggaaagctgatgtttgaaataataacatcaagtataaccttagattttttagtataattaaaaaattaaattttattttcttaaactgtatacttatactttcttaaacagatactgtatgtatacacagatgatttcctatttgtgaaatttttatcatgttttactttatctgtaagcattaattggctttatatttgaatattaatgttacttttatcataaagcactaaatatattttacaacaatgtgaacattcaatgtattaaaagtatataatataagtggcatatttgtggcccactgggttctatttattaatgaactaggcagcaattgcatgtttattttcatgaaatatgttcatgaagaacacagatgagaccaaagttaaataaataatatacctcttatattttaagaaaaccaataatctcaaatataaatgacactgcagaaagccctgggacaatacagttcttagagtaccacgtctgcaaaaaaacagtaatttttttaacaatgttatgccaaaagtttagttttccagaagacacactgctaaagtttttgcaacaatagcacagctatgaaaaattatctgtaacgttcctaaggaacacaaaaagtataaaaagtgtaagttcttaattccatgaataatacatagctatctgaaacatgtacatgtgtttgtgtattcacacttagaagggtgatgatcaacagttctactcaaactgaaatttttaatttcactgcatgaaatagttatatatccctattcaacattaaatattctttagacacaatgtcttacttcttaaaagaaatctgataataatatttttcagaattttatgtaattctgagtggttagactttcttatcatatttgctatgttaatgttatttattctttaaatacagataagacatatacatgacctttaaggccagttatttcctagtcccttatattaaaattatctgatttaacttcacctgtgtctttcatatgctacaatacatgctggcataactatataatttgtatgtatcttacatgaaatattaaaatatttaacattcaaaatgataattctaaattactttattggtgtagccaaataaatattcagttgtttacttcaaattcacttatgaaaaagtcataatgtcctcaataatttttaatcaatctcaaaaaaggattgattattatagaaagtcttagattatgatgcaaatgacataatgcaagttcatagaaagtcttagattatgatgacaatgacataatgctagttcatagaaagtcttagattatgacgctaatgacataatataagttcatcaacatcaaaactgactttacacagaggcatattaggacaatagtctgctttggaggatcatggagaatattttgaagacatggcatatttgcttatcctaaaatcttatcattataaattaagtcatttgttgttttccaaaccaagttacacataaaataaagaacttgtaagtgggaaattaaaaacacctccacgaggcaagtgccagacacatttttataggaaggctatatgactcaaaaacaataagtgaattgcagaggatcaaacatattttgtccaaaaatatgggtaaggagatcttcatggaaaatgatgccgtaaagatgctattactttattaaagtggtggaaagagagcactggcaatggtggaaatggttccgaaaagcagacatacaaatgcaaatcttcagaattctcttagggcacattattacaatcacaaaaagtgtattaacatagtattgcatggcaaagaatataacaatctgtaatatacactcaatacatgactgactttctaaaattaagaaataataatagtaagaataacaataccattttcatagaaagaaattcttattactctatataaatgagacataagcttcctttactcgtaatccatctgtagagtttaattaacaataatatacgagctgataactatcagtggaaatataaataagaatggaaataattggacttcttaaaattatttgcttcttttctttttcttaaatattggaaaatatgtatgattgttcttagaaaaatatttgttacccattgattaggatatcttttcatctggaactgtctgtctattctggaaaaagcagctgaaaagaccaaaagctgtgcatagatttatgtcagccacttggagatagacaaaatttgaagttcagcatcaaggaacttcaaggaaggagaagcttattaaacctccaattgtttgatttggcttcctgaagagctaaaccataggactaggattttaagaggaacaagaaaaaaagagaggattagtgaagtgaaagacaaattcatagaaaatatccaggctgatgaacaaaatgaatggaagacaaaaaagagcacttacaaattctatgggaacctactgacagaaacttatgtgcaaattagtaagtcacaaatgggagaagagaagaagggaagaagtgacaatgactaattaacattgcaaactgaagaaattccaaaatccttagatttgagaactgccctgaagagaatcaatgcttaagcacatccataatagaacttctggaaaacaaaacatagaaagagaaaaggtcaaaggcatttgcagtaaattcaaatatagataattcattagcagagaactcacaattacaggaatattcagtggtattgatcaagtttaaaaaacaagaaaatattaataaaaaacacatgtagagaaaatctaaagaaatattggctgtgtaaataaatgccttatttaaaataaaattccattaaatacacaggacaagtgtgctcctttcactctgagtatagaaacctgaaaacaaacatcactctcaaaggaaaaatgagaaacaatgagataatatacaaaatataattattttaatccattcaacgagttgaagttacaagtctgttaagggaactcaactccaaggagtgttaagctctttccaagaacacaagatgtatgaactgttacacttttggcaggacacagccagaaatctgcaaaaagccaaaccaaagcaataaaacaagcacaaaaatcgaacgatattctaaagggaaacagtagggctgaataccagtttacaatgattgggagccccagatacaagagaaatgtatatttaatcacaaatgattcttcacttacttctgctagatttttaatagaaatagatttaaattaaaaacaaatagctttaggggtacaattgttttttggttacagggatgaattgcatagtagtgcagtgtgggctttgggtttacccatcacccaaatagtattcattattcttaacaggtagttttcatctctcacttccctcctaccctcctcccttctaaatctcttccaatgcctgttagagtaccctgtatgcctttacatatgcatagcttaactcccacttgtaagtaagaacatgcagtatttggctttccattcctaagttacttcacttaggataatggcctccagttccaacttgcattggtgcaaaagacatgatttcattctttttttatggcagagtggtatttcatgatatatatatatacagtacattttcttatccatgcatcagttgatgggcacttaggttgacttgaaatgtttgcaattgtgaattgtgctatgataagcctaagcgagtaggtatctttttgatataatgacttcttctcctttgggtacatacccagtagtgggactgatggatggaatggtagatctactcttagttctttgagaaatctcaatactgcagaaatagatttttgatggaaatcttaatgggcagaggagaagactcaatagagtctccttagcgttcttaggaaagataactttataccaagcaaaaatatgtagttgagaaaaaaaatggagaaaacagagactggttgcaaaatggcttgaatggtggggtgacagagagacagctgctataaagcagctattctaaatatttttaagaattaaactatgctgctagagagcagtaaagaaatataggctgttttttctctctcctgatgaaggagtgacagattccgtcatacataggccccaagacatatggatagaagcaaacccatctgcctctagggaagggttgggaagaacctgctccatgctcctgagagcaaagcaaaaatccactgctctggggaagcgtacatgcaaaatcctctgcccttgggggtgaggcagaaaaatcaggctctgaagtctttgggaatacaaatcgctgttccactaccactgttcacaggggaataactttatcttatagaagacccacaagaagccaggtgcagtggctcatgcctgtaatcccagcactttggcaggctgaggagggtggatcatttgatgtcaggagtttgagaccagcctggcctacatggtaaaaccctgtctctactaaaaacacacaaaaacattagccaagcatggtggtacatgcctgtagtcccatcttctggggaggctgaggcaggagaattgcttgaacccaggaggtggaggttccagtgacgagttcacactactgcactccaccttgggcgacggagtcagactctatctcaaaacaaaacaaaacaaaacaaaacaataacaacaaaaaaagacccacaacagatacaagacaaaatttggctgccatgggtggagcagaggcaggaacactgaaaagccctaactcctgaggtccaggcatgcagcccatgcaaagactgaggctggatgaggagagacaagaacttgctaccccagacataagcatagcattagcataaatagtatcaaaagcatagcaacagcttccaccactggaagagagacaagagcaaagagaaagagagagagaacatcctgttattagaaatccaggaacaaggtgaaagatgagggaaataatggagcggaaatgccaagagaagttctccagaattctaggacacacaacaacagcacaaagagaaatgaatgtgaagtctgtgggaactgagaaaatggtaatgacaaaacacaagcctacaaaacacaagcctgtctcacaaccaacaatattaacctaaccctacacaataacggcctgacaaagaaagggtcatacccatttctaggcataaataatgtatacctgtttcacctgctcttctaaacttaatgtctggaatttggaattagctatattatatcagagataaaaatttcctttagtagtctctccagtaaactaatcacagctgaggaaagactccactggacttaaaagtagaataataaaaacaattcaaaataaaatgcaacaagaaaattgtaaaaagataaatagtacactcaagagctgtggcacagaatttaaaagtacatgtatttatagagagaggagagggagaagaaaaggcaaataaattctttgaagaaataatggcacaaaaatttctaaagtaaataaaaagctacaaaccacagataaaggaagtttcgataactctaacaaggtaaatacaaaataaaagaaatattttataaagaaaaaaaatcacagtgtgctgaaaaatgttaagataaaaccttgaaggcatctaaggaaaaatgaacattctgtacagaggaaaaaagataacaatgtaaatagcttcgttttattttgttttgtttttcagaaactatgtaagcctaaagagagtggagagatatcttgaaattgttgaaaaaagcaacatgccaacctacaatgctataccaagcaaaaatatcttatatggtcaagataaaaagaatatagaaaccagttgcaagatggctcatatgacgggtttagagacaagaactctcaaacatctattttaaatattttgaaggattaaaggaaaatgcagccttaataaattaatagtttggaaaatgcaaggaataaatggaaccaattaaaaaataaccagacacagaatttagaatggaaaagtccaagaatcaaaataagaaattcactgcatgttgttaacagcagattggagagaattgaataaatgaaaagtgaacttcatgatatattagtaaaaatgacctaatctcaacatattctttataagattgaagaacagattaccagttaggttctaacatggcttatagttggagcctcagaaaaaagagaaccgtgagattggaatggaacaagtatttgaattaaaaatgaacatttgtcatttttccagtttgatgaaaacacctacttacagacccataccagcagatcataggcagaataaataccaagaaaatcacatcatagtaaaactgctgaaacacatgacaaattttgaaaatagccagagaacaaaagaattattacaaacaaaatactgaaatgagtgataactaacatttagccagacacaactgaagccacagataatgcaatgatgtttctacaatgctgaaagaaaagttttcagaacagaatccaggaaaaatgttcttaaaattagaaggaaatacttatacagttaaataaatagtgaagttttgtggccacagacctgtattgggagaaaggctaaagaatgtactttaagctgaaagataatggtaccaggtaaaaaataagaagagtatctgaaattgcaaacgtgggtaaatacacaattttttatgaattgatttctttattggcaaatggtaagagaaatataacagcattgaaaggtgagatttatacagtatgtagaagaaagaaatgaaaaaatagaacaaagtacagtgggtataaagtataaaatgtaaaatgggaagtacaaaataggaagtaggaacctagaatcatcacaagtgatgtggaaaatggaataatagtaagtttaaatgttgaatatttgaagatgtgtaatataaaatctaaagatgctgctaaaataattacacatatagagagagttaaaaggcactagaatataaattaatgaaacacagtaatagaaagtaaaggaataaactcacacatatagtcactgatttttagaaaaaggtgttactatattatgatacaatatatataatatgctcacctaatagtacataaaaatgacaaaaattatattgaaatgggtcattggtctaaatgtaagagctgaatctataaataaaatagaagaaaaatatgaaaaattcttattatcttgggttaggtaaataatttcttgagtagaatacaaaaatcataaactataaaagaaaaaatatatacattagacttcatcaattctttttcctattcaaaatacataaataacaagttggaaagtaaaactgtagcctagtagtaaatgtttgcaaaattttgcctgaacaaagaaatgtattaaggagatatataatatctatattccatagagatgtataatatatggaatatagagaaatagatattatatacttaaaactccaataattcaataataaaaataactccttgaaaatgaaaaaaaaattaaacagacactccactaaagaaaatataagaaaagaaaaaaccacatggaaagttactcaacataattagtcattaaagaatgcagattaaactacaataagttgcaactgtatacctacctgaagccctaaaactaaaaacaaacatacaaacacacaaaaaacaatagcaaaaatattaaatgctggctagtagcaagtggaaatcacataaaatgagggtataaatgcaaagtgatactgtaacattgaataatggttttgcaataccttatgatgttaaatacaccacaaaacctagggtattagtccattttcatactgctatgaagaaatacccaagactaggtaatttataaagaaaaagaggggtaatggactcacagtttcgcctgtctggggaagcctcacaatcatgccagaaggcaaaggaggagcaaaggcatgtcttacatggtggcaggcaagacagcatgtgcaggggagctgccctttataaaaccatcagatctcatgagacttattcactatcagaagaacagccatgggaaaaacccactcccatgattcaattacctccctttctgtccctcccatgacacatgagaattatgggaactacaattcaagatgagatttgggtggggacacagccaaactatattattctggctgtggcccctcccaaatctcatgtcttcacatttcaaaacacaataatgttttaccaacagtctcccaaagtcttaactcagtccagcattaacccaaaagtccaagtcgaaagtctgttctgagacaagcaagtcctttccacctatgagccttaaagtttcagaatgttctcctttggactccatgccttacatccgggtcacgctgatgcaagaggtgggctcccatggccttgggcagctctgcctctgtggctttgcagcatacagctcccctcctggttgttttcacaggctggtgttgagtttctgtggtttcttccagttgcatggtgcaagctgctggtggatctaccatcctggggtctggaggatagtggccttcctctcacagctccagcaggcagtgccctgttagggactctgtgtgggagcacccaccccacatttcccttctgtactgccctacaagaggttctccatgagggctccacccatgcagcagacttttgcctggacatccaggcatttccatacaacctctgaaatatagatggagattcccaaacctcaattattgacttctgtacctctacacactcaacaccatgtggaaattgccaaggcttggggcttgcaccctctgaagccatggcctgagatgtacattggcccattttagacacagctagagtggctgggacacagagcaccaactctcaagtctgcacacagcaggagggccctggacccaccccaggaaaccattttttcctcataggcccccaggcctgtgatgggagaggctgtcatgaaggtctctgacataccctggggatattttccccattgtcttggtgattaacattctgctccttgttacttatgcaaatttctgcagccagcttgaatttctctccagaaaatggctttttcttttctattgcatcatcgggctgcaaattttttttatgcttttattctcttcttcctcttaaacacttcgctgcttagaaatttcctctgccagatacactaaatcatctctcttaagttcagagtgccacagatttctagggcaggggtaaaatgccaccagtctcttcacatagcaagagtgacttttactccagttctcaacaagttcctcatctccatctaagaccatctcagcctagaccttcttgtccatattactgtcagcattttggtcagagctattcaacaagtctttaagaagttccaaattttcccacttcttcttgtcttctcagccatccaagtctctaggaagttccaaactttcccacattttcttatcttcttctgagccttccaaactgtttcaacctctgcgtgtttcccagttccaaagctgcttccacattttttgggtatctttacagcagtacccacccctggtaccaatttattgtattagtccattttcatactgctatgaagaaatactcaagactgagaattatgaagaaaaagaggtttaatggcctcataatcacgttggaaagtgaaggaggaggaaagtcatgtattacatggtggcaaccaagagagtgtgtgcagaggaactgctatttataaaactattgtatctcatgagacttattcactctcaggagaacagcatgataaaacctgcccccatgattcaattaccttccactgggtccctgccatgacatatggggattatgggaattacaattcaagatgaaatttgggggaggacacagccaaaccatctagcaacctaaccctaagtatttacccaagagagataagaacatgtatccacatgaatgcttgtgctcaaaagttcatattaacttattaataatacccaaaaactataaaaagctgataggactatattaatatcagataagttacactttaagacaagaagtattgctagagaaaacagagtttcttcataatgatgaaataagaagttgatcagcaagacatagcaatctgaaatttgtgaaatcctaataaaaaaagacctctaaatatgtcaagcaaaagcagatattccctaagggagaaatggaacaatacagcactacagacatattgtttaatgtaatttctataaatgatagaattaggcaaaatacaatatagaatatgtgaacaaccctgagacaactgatatttataaattcaagtaatttaaacaagtgcagagtatatattctttcaagtgtacatagaacattcactatgacaatctcacttttatattatactttcttttataaatatattttgtataaaaatgagttataaaaatataagtatcttaataaattccaaaagatggaattttttagcatatgtcctcttatgaaaacagaattaaattagaagtgaagataaattagattttcagaaaaattcccaaatatttgtgtatttaataacattcgcttaaataacccctagatcacagaataaaatataactaaatttagaaggtatattgaatttctaaaagtttaattttgacctataagagatatacgcaatgaaaaatataagctatcaaaatttttgggacactgctaaactatagcttgaagggacatttataatgtcaatgcctatggtagaaaaatggcctaaaattaacaggctaagattctttttttttctttccagcctccaagatgagattggctaagattatttcacaggaaactagaaatggaagagcaaagtgaagctaaggtgatcatggaaaagaaataattgatgtaagaacaaatactaataccataaaaacatatcaacatacgactatgggagcaatgcatttcagcccgtaacactccccagtagagaacaaggtatggatacctgcagtcatcacttcattttctttctgagcattttaggaattgcaataaggcaaggaaaagaaatgcatgacataaagtttgtaagataaatatttagtcacagatgacagtattgtctgcataaaacttctgtagaaatctctgaaagaagtgtcagtagtaatatgtgaatttatcaagatagcaggatacatggccaatttttaaaaatcagttgtatcttttcaatagaaacaagacatagaaaattacgttaaactcaaaataatttaggatattatcaaacacaaaatacttagaagaaatttaacaaaactataaacttacaaactagttaaagtggtaaccaataagatatacataagtggaacggtattccatcttcaaaaacaggaagacagtaatattcaaatgttcattatccctcaattgaccaagagattcaatgcaattccaatggaatatgtagcaggaattcataaagaacaaaaagcagaatataaaatatatgtggaaatgctaagtacctagaaatgcctttttaaaaaggatgttggatgttggccttatactgacttcaacactgttgtgcaaggggatgaaaagcaccatcatttagtgtgacatactgtggatacaacagagaagtactcaaggaaactcacacgtactgaaatagtggagtgcatgcagcaacctcaactcccattccacagcatagactgagcatcgtgctctctctacaccaaggctcagggctttcgcagtgagtgtctctgaatgtggactgacagctgactcagcacacttctgtgggaggagaagttccttcccacgctactttacatatatatatatatgctaacctaaaatgggctagggcacacctagtatatccaagtaaggcaagtgtatcaaaggatctccagacccaagaatggcactaaggagaatgcatatctatgcatatctaagacctgaatccagttttgtgtgccaggaatgctgctatcagccaaatcctttctgtctccctgtcactggctcagtctagttgaacaactttattgctaaactgccagatagagggacacaaaaggaccttcagagatactcagatttccctctcctcagtgaattgctgcatagcaaacccaaagtaatcaaaacagtgaggtattgacatgtgaatactcaaatagagtaatggaaaacagtcttgtaatgctgctacatgtatacacagtcagtttttttttttgacaaagtgccaaggtaatccagggagataaatattaaaactattaaaactacaatgagatgctattttatacccactagaatggcttccactagaaaatctgataatagcaaatgctattgaggatgtgtggtaacttgaactttcatacatggctggtaggggtgagaaacagtacaaccactctgaaaagtaattaaccaacttatcaaaatgttaagtagtcacttatgctatagcttagactgttatttgaaacatagatcctaaaggtgagtgccataaatcaatttgcaaaaatactataaaatgctttgtcctgctgtcttatttaacaaaatatccaaacactatattcatataaataaatatgcacacacacacactcacaaaaatagttgagccttattatttgtggattccgtatttgtgaatttacctgctagcaaaaatttatagttgtttgtaaccccaaaatcaaaattctcagcactttcaaggtgatttgcgggcatgggctcagcagcaaaatatttgagtcactccaggaacatgttctgtgctgagtcaaagcaaagctacgcccttttgtttcgactctcacaccgcaaacgagcatccttttcacagtctacttaatgtcactttttttcatatttttctcatttttgtgggtgggttccctgtttataacggccccaagtatagtgctgaagcactgtgtagtgttcctaagtgcaagaaggctatgatgtgctttagagagaaaatacgtgtgttggattagtttcattcatgcatgaattatagtgctgctggccataagttcaatgttaatgaatcaataatatgttacaaccagaaaaagaaagaggaaatttgctgatctgtatgtgaggccagtccagaaagtgctaatgtgacacctatagcgcataatgaagctatggaaaagatagaacaataggtaaatttgtggattcgtgagaagactgattgtttttaaatgtagtagacagcgttgttgtgaggctggaaagcaaagaaatttatggtttcattatgcagggtcaggaaaacgttaaaaacgttgaacacctcctggctggtgttggcttgcatgcatgttttaaaaggtgatggggtttgagcaattttatgcttgcaggtgaggtaggtgctgcagtccaggaagctgataaagaatgtctgaaataactgccatgtgttacacagaaaaaggataatgtagaaaagcaggtttttaatgttgacaagattggaatgttttataagaatgttggcaaagaaacctgcattatgcaaacggcctcgaaaacccctggtcttaattcatgcaaagacaatgaaattaattatttgtaacaaatatatatcaaagaaggtagttttaaacgaaacacacagaaaacaaagcttcgtattgatcagttgatgaacatgtcctggccagtggtactcaggaatccagtgttgtctttccccgggaaaaagggctttatatttatttgctaattgagtgtttcatgtctttagagaacatgactatcgtgaacaatgaaaatctattatatattcagtcatataatatataaagtcacatatatgtggtttagtttaaaaaagtaaacaatcctaatttaatctatgtcccagaagttgaggaaatgaatcgcttcaatgagtaacttttaaatcattttgtatgtaaaagagtttccaattattttctttcaagaaaactgaggaatgatcaagtcaagttgatagctgataggtcattaaaatattttaataacaaatcactatttgatttttagcatgaaacatgaaagttgtttagttaactgtctctcactctaggaaaagtgtcgcccaggcaggagtgcagtggcgcgatctcagctcattgcagcatctgcctcccgggttcaagcgattctcctgcctcagcctcctgagtagctgggactacagacgcgtaacaccatgcccggctaatttttgtatttaatagagacagggtttcaccatattggtcaggctgctctcgaacgcctgacctcaggtgatccacctgcctcagcctcccaaagtgctgggattatgggcatgagccacggcgcatggctacaggatttttttaattgtagaaaagtggattaatataagtaagtcctaatattacttatatcctaatgagtacattttaaacattgatatagtagtttcaatttaaaatgaaatgtttacaaaacctcagaaattacattatttttaaagctttaaacttaatataaaagcactcaacatgaacaaaatacttaggttacatacacatatttttaatttttttttaaattgtcacaggaacaaaacaatattaagtgatgtgaaaaagtcctgctttttctcaatatattgtgccaatttctctaacactattcagcaaaactttttttacctaacaatattattacttgtaagtgttcaatataaacaaatatatgtctcttctgagtgctctttttattagattgctctatatatgtgttttggtctagcggaattttaaaactattattgctttgtataatgcatgtacatctgttagatggtgcaagtatgtgtgtgtgtggatttatttatttatatggattagtgtctggaaattttgttaaatcaggtagcaagataaacaatttcatagtattttttcaaattgctttatggcactccttttagcatctgcttttaataacaatttaggaataattgaggtaaatatattttaaatgtattattcttactgacttcaatttaaaacataacaaaatttgaaacaaaaatactactatgatttgaatgtttgtatccatttcaaattcagacgttaaaacctagtcaccaatacgatactattatgagatgcctttggatatctggtactgattaaattataaggacagggccctcatgaataggattagtgcccttacaaagaagtgccaagggatcctgttcatcccctccaccctgtgaggacttagcaagaagatgccattaattaaaaaagcatgaaatttgccatgccttgatcttgggtttctctgacttcagaactgtaagaaataaatttctgttgtttataagctaccagatctatggtgttttgttgtggcagcccacacagactaagataccgctgtaggttaaatttacttcatattgaatgaggaagggaataaaactaaggccagatgaaacaagcagggtgctttgtacgtctctggaatgataaggtcttgtaaagtgataaaatctctgtacctgaaaataattatttaaaaacataggaggaggagagagactaaaaaataaagaaagcaaattagaaaaaaagaatagactgaaggatgtggacagtggaaggtgggaaaaaatgaggaaaattattatctatttacaggagccgacaataatcattgcgaaattactatagtgatgttttttccttctctttccctcctagttgccctcccatccagtgatctaaatgttttaattaagcaagaaagtatttatgaactgtgtgggcatgaagagtttggacagcgagcattcttctttactaaaacaaatgctaatgataactaagattcattagttgacatgtggtatgcaaattatatttcacaccaatgttcagttcacaaataatatttcatgcccaataatcttgtatcgtaaaacatattattgtagcactgttttacaatggagaaacaaggctccctcagatttggttaattttctaatatcagcaagtaagtggcagagttacaaatcacagctaattctatgccataaaaaaatgcaaggagttgcatttaaacttatagtttaataatttaacatattaccactaataattaaatcatgaaagataatatattgattaagggtgctttgtgtacagggtactctgatttaaaaaattcactaaattcccatattgtctcctcaagtttggaagcattactattcccatttcacactagagaaaatttacacagaacttaagtaatttgctgtaacactcacagttatcaaggaatggagcttggctcatattctgtctcattaatcttcaaagtttaagaagtgtaacctgcactttccataaaaatggagtcagtcttccatatccacaggttacgcatcctttgattcaaccaacaatatatcaaaatatttggaaaaataaaaaataaagaagtagcagtaaaaatcaatacaaatagagatacagtacatcaactatttacatagcatttaccttgtattgagtattatctagagatgacttaaagtaatctagagatgatttaatgtatacaggaggatgtgcataggttatatgcaaatactatgccattttatatgaggaacttgagcatcctcagattttggtgcccttttggggtgagtgcctgtgggtagggagagtcctgaaactgatcttcagggaacacctgcgaaccactctatgttaagtttgtgttcacattatttccaaatacagggtgtataaactttatttgtctctccaaatgataaaatgttactttgttcatacttgagcagttttaaacaaattgatttgattgtgtacttttctattttggttttcaatgtgagtattagtgtaaatattttgctaatcctggattagacctgtatggaaatgaaaccagcaaaaatattgggaaacagcaaaattaaaatactttgaaaaaattttcaaataatctttgaatattacagcatttaagagaataataaaatgattgaaataaaaaagtgtgatcacacatttcctaattttgattctgtcaaagtacctctggtatatttattacttttaacaaatattttaaatgattattcttacccattcatttataagttaactaaataaaacgaaggatcatggaaaacttaataatattcaagaggtacaaagtaatactaaaaatttatataggagattttgatttatggcttgaaagtactctcatctagctctcatacatagttaagaattcttgctgggcacagtgactcacacctgtaatcccaggactttgggaggccaagggagggtggatcacgaagtcaggagtttgagaccagcctggccaacatggtgaaactccattgtccctgtttgcagatgacatggttgtatatctagaaaatcccatcgtctcagcccaaaatctccttaagctgataggcaacttcagcaaagtctcaggatacaaaatcaatgtgcaaaaatcacaagcattcttatacaccaataatagacagagagccaaatcatgagtgaactcccattcacaattgcttcaaagagaataaaatacctaggaatccaacttacaagggatgtgaaggacctcttcaaggagaactacaaaccattgctcaatgaaataaaagaggatacaaacaaatggaagaacattccattctcatgggtaggaagaatcaatatcgtgaaaatggccatactgcccaaggtaatttatagattcaatgccatccccaacaagctaccaatgactttcttcacagaattggaaaaaactactttaaagttcacatggaaccaaaaaagagccagcattgccaagtcaatcctaagccaaaagaacaaagctggaggcatcactctacctgacttcaaactctactacaaggctacagtaaccaaaacagaatgctagtggtaccaaaacagagatatagaccaatggaaaagaacagagccctcagaaataataccacacatctacaaccatttgatctttgacaaacctgacaaaagacaagaaatggggaaaggattccctatttaacaaatggtgctgggaaaactggctagccatatgtagaaagctgaaactggatcccttccttacaccttatacaaaaattaattcaagatggattaaagacttaaatatcagacctaaaaccataaaaaccctagaagaaaacctaggcaacaccattcaggacataggcatgggcgagtacttcatgtctaaaacaccaaaagcaatggcaacaaaagccaaaattgacaaatgggatctaattcaactaaagagcttctgtgcagcaaaagaaactaccatcagagtgaacaggcaacataacagaatgggagaaaatttttgcaatctactcatctgataaagggctaatatccagaatctacaaagaactcaaacaaatctacaagaaaaaaacaaaaagccccatcaaaaagtgggcgaaggatatgaacagacacttctccaaagaagacatttatgcagccaaaagacacatgaaaaaatgctcatcatcactggccatcagagaaatgcaaatcaaaaccacaatgagataccatctcacaccagttagaatggcgatcattaaaaagtcagaaaacaacaggtgctggagaggatgtggagaaataggaacacttttacactgttggtgggactgtaaactagttcaaccattgtggaagtcggtgtggcgattcctcagggatcttgaactagaaataccatttgacccagccacccattactgggtatatacccaaaggattataaatcatgccgctataaatacacatgcacatgtatgtttattgtggcactattcacaatagcaaaaacttagaaccaacccaaatgtccaacaatgatagactggattaagaaaatgtggcacatatacaccatggaatactatgcagccataaaaaaggatgagttcatgtcctttatagggacatggatgaaactggaaaccatcattctcagcaaacaattgcaaggacaaaaaaccaaacaccacatgttctgactcataggtaggaattgaacaatgagaacacatggacacaggaaggggaacatcacacactgggcctgttgtggggtagggggagtggggagagatagcattaggagatatatctaatgttaaatgacaagttgatgggtgcagcacaccaaaatggcacatgtatacatatgtaactaacctgcatgttgtgcacatgtaccctaaaacttaaagtataataataaaaaaaaaaacaaaaatgagctgggtatggtggtgtgttcctgtagtcccagctacttggggaggctgaggcagaagaatcatttgaatccgggaggcagaggtcacagtgagctgagatcatgccactgtcctccaacctggacaatagatcgagactctgtttcaaaaaaaaaaaattcttaatatatcataggacacatttcatttattattttttttctaagaaaactaccaaagtaaaacacagctcaggtatcaaaagtttcaattgcatttttaggcttcctcactatttgttttattttttagaggtgtgaaaaagaaatagtgaaataaatgaattatgaagacacctgcaaggcaataggagcaagtataagtttggaataaaatattgccatgattataatgggagacattttgtaattacacagtgattaacaactatatttctattttcttgcctggctgtcataaacagccctttttgaagctgcactaatatgagtattgaaaaagaatacttatggctcttttgaatatctaacctgttttgattgaagattatgcaaatcacttcttacagtcttattaaaagataacatttaagctgaacactgaacaattccagttaaaatatagatcatggagttagtagattctgccttactggtttcttgtgcacactgctaggccatataaatattgtatttgcattttatatattttatatatcatctatctagggcctgctctcttccactatgataatatatgcgtatatattttaatatttttggcagaatattttcatgcaaatttgagagaaattataaacatttcagtataggatctggatcctcaatataacaaagtgtattagaactgtgagtataagaccctctgtcaatgtcagaagattaggattttgggtgagataaataattaagaaaatctttgtaaacctagtgatctactttgtttggctttcttacctttgtatgaaacaagggaaaaataatactaaccaaaatatttaaatggagttgtctcagtgccttaatctattatatggttttatttagagctttgtcaaattttattataaattggaggcaacttaatatatgtattgattaacaacgtaaaatacattttagatgttttaagtaaaatcctgggaattcctgctagatcttggtaatattaagacatgtcaaaattaaactaaaggagttagtgtgtctgcgtccttctggaaaaaaaaattgaaatgtttatttgactcatgaaagaaataaaattgtaccaagtgatgcatgcattacgctttataaagaaagcagtagtcctcaaaagacaaatcaaaatgagaaagaatttaggtgatcaaaacaaaatccactcatacttgatgcttgcagtatttgttttccatttgtatttatttacagagaattgacttgcttcataaatataaaattatgttcttgcaaaaaatatctacatatacataagcaaatatccttggaaacacgaagattgtttccagcaataactttgaactgagtagaggatcaaaaggtgctatgtttctgtggcagtaaatttctggtcttaatcttgtttttaaagccgactattatgtttgtaatgcagataattgggagtgcgttaggggacattcagacaagctgaccatgttcgcatttcactcctttgcgaaggtctaatatatatggtttatcagaaatgactttccctgtttggaatgtttcaatgatgaactattctttccgaaactaccctagtgctacgatttattttgaagggattctcattaaattgtgcactgctgtattgaaatacatgattacaaaaaaaatgctgacacaagtattttttcatgttactctttaagttggttgattttctgtgaatgttaaatcagggacaagagcttactattcttcatctgcatagagatgaagatattgcatcaatttattatttcttcctgcacggtcagatattttgtgcatgtgtgtgcgtgtgtgtgtgtgtatttgtgatggaagaaagtgttctaaagaaatgcttagtagaactaccttttactagtatcaggaggatattaaaaattacttgtagtattaaatatttctctatgcaagctcaataaggcctatgtaatttaaatattgttcacaaagacaataacatttaaaatacatcttgtaattctaaattttaatgtcattgtggtagttaagtatgtggtataaaagtgtatccctgagttaagatattctgtctttagaagacacacttgaataattcatatctttattttgcctaaatgtaagtttattttatattaccgttgattaagaagaaattgctttcaatctaaaattataggccttatttaacaaatttagttatattttaagatagcaattacatattaattagtcattcttgagatattgcttatggcatgtttgggaactacgtctttacaacaatgcattttaatatttttttatttttagaatatacctcacaagtatagagatacaaaatatttaattatattgcttataatatgtcacgtagctttgtatattatcggtattattatctttaattaactgggaagaatatctaatgtcttttgtatctaaaatattgtgccttgaaaatacacttagtacaaatataaatatgctttaagtgagtgaatatataatattttggatttatttgagaatgccattttatatgactgtgaattctctagccatttgtcaacacctgcgggactggactggactgcagagataaaaatgcatgaggtcattgctcagcttgctccatcatcacctcagaatgaggaaagcaagaagaatagctgaagaaagttgtctactctctcaaggtggctgagggtcctcttcaatatgactcatctcatgtttttctctgattcccgagatagtgaaacccagggaacatggtagtttagctagtttttacagcaattctctctctctatcaaaattaaaggaaaatatctaatgagaatgctcttaaaatctgtcttcaaggaattatatcagaatagaatagtgttcactatattttaacatgttaatataaaatatattttcactctttgcattggtattggtgaaaaaaaagttacctgattacattttcctacttgtgttagattgtagacatataaaggctaaatacatgctccactcttagtgaaagttgatagaattctttaaactatcttttacccttccttaaacttttcatataattatattcaataatattatccatattgtataaaaattgtatgaaaatattttaaaaatcaggggagatatctatctctatatatagagagaaagagacctactagacacactgtgagttctgcaatggatttatctgtagcacttcttggcaatagcagtttgtgaaacacaaactttaatgcaatgctggatatcttaggacaatatactccattcatgtgcatagtgttaaattagaaggtaatcttatcaaataatgtaagcatcatgaatatagtattgtttgcaattacttccctagcacctagaaaagtaagtaacccttcataggaactgcaatgtgattgagtaacagtcaattttaagtttatcacaatttttgagaattactgaatacaaatacttttttgtgaaatatattttgtgccgttgtgaaatgcacatatgttagggcattaaattctgcttaagtggagtatggttaggaaatgtggtaatactcaaaagacctatctaggtgttatttttattgagaattgaatacatttgatttcaacaatcacatactaatgaagtcatagatacatttaacaaaagaagcaaagttacattgtcaacactagtgaactcaatgtatacatgtgaaggcagcaaaaagagagtggtgagaggaaatagaagagtgcccttacccacatactggtatggctcgtggaggactttgagtacgaaggtgaaattatgtagtttgagaaagcatatcaagtgattgcaacaaacctacctctaaacaagtaacttttctgaaggaaatccacactaaaaataaattggccataagggagctctctgtctatgaaatagtaatgtaatttctttgctctgttttatgactaatttccattactgaacactttccagttgcataaaagttgatattcatagcaaatgtattaatgtttaccactaataatattcctttgtacaaatatagtatcaattatttatccattctaattttacattaggtagttttcttttttctttcttctctttggtttttgctataaaattgctgctttactacttgtcatgtgcaagtttagacatgtggtatatgcctacatcatgggtttcacacatatgcaccttcattaagcaatgatgttatactcttacaaggtgcttatagctgattctacttcctagcaatggctatgcccatcaagccacatctaatacttaatatcatcagaatatttaatttctggtaatcatttgaatgattattaaaacacaataatgtacaataaaattttttaatttatttaaggatttttatttacatttttggtaactaataaagttaaatagctaattgtatgtttatgggccatttgtatttccattctataaaattcaagtctttatccattatttttctgttcaattgattgtcttagtgtttagtagaatttctttcaacctatacatatagatattttgtgtgttaaaaatattctcttctattttatagcttgtctaatgttatttttattatgatgtatatgaagaacagtctctcaatttgaatgcagaatttgtctcagactttctgtttgtggtttacattatttatatgcttttaaaacaggattttctacaccaagctcagaatgatattctactattatgtaacttatttaaaattaattataattactatctcttttctgtaataatacctctatctcatatccacatgtgtaagcatctgtcagggctattttcttccattgactggattttctattttcctccaatcccttaatgagtacaattttataataagttatggacatctgaaaaggggcaataaacatttttttactatatttctttctttttttttttggagacagagtctctctctgtcttccaagctagagtgcaagtggcacgatctcagctcctcggcctcccaggttcaagggattctcatgcctcagtagctgggattacaggcgcccgccaccacgcctggctaatttttataactttagtaaagacagggtttcatcatgttggccaggctggtctcgaactcttgacctcaggtgatccgcctgccttggcctcccaaagtgctgggattacaggcgtgagctaccgcgcccgacccctttgttcatatttttggacatgtatgaatctaccttttttgaaatactttctcaggtcacaaaagtaaaaccaaatcaaaacaaaacaaaaaacccaccaatagctacttattatggttatatttaataataaaattaattggaaaattaaaacattttctacattaaatcccctaaaaagtaaaagtgatatattttaactgtattttggacatatttaatatttatcagttaagttctataatattctccagaaagtttttgtacatatttcatttaatatatttataggttctttatattattgtatcataaattatattttattatttataaagtgtttcctgttgtacataaaaatgcaacttaatttttatactgattttgaatctagcaatcttgttaatcacttctcttatttatataataataatttattgtatataccttttgattttctacacaataatggaagttaatgaaaaagtgtgtatcactaacaaccatgagtaaataaagggttctttatctttatttgataagggaatcttattaaacctatgtgccaacaaattagataaattaaatgaaattgacacattcttagcaggacataaactataaaaactgactcaagaataaatagaaaaccaaataaactgataaaatattaatagattggattaaatattagaaacttcccataaacaagagctaagttctagagggattcactggtgaattctaccaaatatttgagaaaaaaattaatattattttttcataaatctttagaaaaataaaagaaaggaaagcactcttcaccttattctatgaaaccagtaatacccttttccctgatactaaaaagagaccaaggcatcacaaggaaattacagaacaatatttttgtatatagacacaaaaatcaccaaccaattactataatgctatagtattactatatccaacttggatttattgcaggaatggaaggttactttaatatttaatgctcaattaacataatatgctacatttattaaataaaagacaaagcacatgataatctcaatacattagaaaaagcatttgacaaaatctaatatattttcacaattataacattcaaccaactaggaataaagttatccttctcaaattaataaagggatctattaaaaactcacaggtaacctagtgaaaggtgaaagactgttttccatttaaggacaggaacaaaaggagggtgtctcctgtcatcatttctcttcaacattgtactgaaggttctagccaagggaatttagaataaataaataaataaataaataaataaataaataaaggcatctagattggaagggcagaagtaaaactattgctacttgcagagagcataatcttgtactgagaaaatcctaaggaatacccctccacacacatacacatacaatcattacaactaatagacaagttcagaatgttgcaaggataacagatcaatatccagaaataaatagcatttctatatgccagcattttacaatccataaaaaattaacaatataatttcctgtacaacagtataatatggaataaaatatttaagaaaaaataaaacaaatttaaacttgtataccaaaacccacaaaatagcaatgaagaaattaaagggaacctacataaatagaaagagatcccatgttcatgaattggaagatttaatattgtttagatggcaacattccccaaattgatctgcagattcaaagaaatctttatcagcacttcagttgtctttttttcttttggttacagaaattaacaagctgattctaaaattcatacggaaactcaaggggctcaaaatagcaaaaacaatcttgataatgaaaaacaaattaggagatctcaaaattcctgatttcaaagcttactaaacagctttattaatgaagacaatgtggcactggcaaatatgtatttcatatgtgtgtgtgtatatagacacatacatatacatatatatgacaagacaattcaatagggaaaaaatcgtctcaataactgtgctgggatgattcaatatccatattcactagaacaaagttggacccctatttcaaaccatatgaaaaattaactcaaaatgacacaaagatataaatgtaagctctaaaactatacaacccttagaagaaaacattgaagtaaagcttgataactctgggttatacaatggtacttatatatgacgccaaaaataaaataactaaagaaaaggtagatacattagacttaatccaaattaaacagtttgtgctgcaaaggataccatgaggaaagtgaagaaacaatccaaagaatggaagaaaatgtttgcatatcacataaggcacttgtattccaaatatataaaaaacttttataattcaataatcataattataactcagtttaaaaattggtaaaagatttgtatattaaattctccaaactaaatctacaaatggcctacaagcacattaaaagattatcaacatcattgctcattagggaaactcgaatcagaactgtaagaaatgccatcactttacaaaaattaggatgactaaaatgaaaagataaacactaagtgttggagacgagggagaaattgaaacacttattcagtgctgatgggaatgtaaaatgttgaagctgatttgaataacactttagcagttccttaaatgttaaatattgggttaccatgtgtcccagcaaattccctccaaggtatacatgtccacacaaaaatgcacatacatgcttacagttgcattataatagcaaaaacatggtttaaaaacttaaatgtgcataaattttggcatatttatgcaatggaatattacacaatattaaaaaataaatcacatgctgcaattggataaaacatggatacaatacgctaaatgaaagaagacatccacaaaagaccacacactgtaggattctatttatattcaatgggtagaactgacaaattctacccattgaaagaagtcagtgattgtctactgtaggtactgtaggtgagtgtagatgagaatgactgttaataaatatggggtttcttttcgggttgatgaaaatgttccaaaattagattgtgcttatggttgcacaattctgtgaatatatgaataaacattagactgtacagtttaaatgggtaagtttcatggcatgagaattatatcttaatacaatttttaagaaatagaagttacatttcctcctttataatcttcacatatattatttatctttattgccttgcctggctgcctaggacctggtgcaatctattcatgcaatctctactcaccacacatgaactccacttggcttctttccaatatagtgtggcagtttttatttgcaaatgcctaatgaatataatgatcaagtgtaaccataatgttcttcatcaaatgactacggagaaatcctaaatcacttagtttatggtactttcttgagctctcttttgaagtgagatgtatcagtgcttttgcatgactttggaaatatgtgtttattattcagtgataggcgtaattactattctgtgataagagtagtttaacattcttgttacataactaatggtataataatggctagtaccttaattatgaccagggaaaatatgaagaaaataataatagtaaaagtaatttgtatagatgtgtaatgcctactatgtgtcaatttcaaacacacattctaagtaaatattatcccaatttatttgataatggtaaaattgaagttcagattttaacttatccctgccaaatttttcctattatataaatttttttaaaattaatcactataatcacagcactttgggaggtcaaggaggattgcttgaggccaggagttggagaccagtctgggcaacatagctagactctgtctctacaaaaaaataacaattaaaaaaattagctggcatggtgggttcacctgtaggcctagctaatacggaggctaaggagggaggacatcttgagcccaggagtttgaggttacagtgaactacgattttgccaatgtactccagcctgggtgagaaagagagatcctgtctcgaaacccccccaaaaaataaataaataaataaaataaaaattgtaaccaaaatttaccttttaaatcaaaaatgttaaaatatcattatatataatttatatttatgttctaatactgttcatctgggaaataaaataattgtctaatacacgtctaataattagttaggcttgaaaccagatggaatatagaaacacaaagatagttttgaaagtatatgcaccaatttttttactctttctttaaataaatatacctgagactaacacattaacatttaaggtctgctaaacatctactattatactttaagattaatttggtaatgttttatttaataatgactttaaaaatatacaacattgttatcttaagtatgtctttaatgaattttacaagtctgcattttaagtcatgacttgaatgcatttcacaatattatttatagctttaagtaacttgcttcagaatatattgagcaattgtatttatgcaatattttcctacaatatttgttgaaatatttgaccatagcaaacatattttgccacaaattaggcattcaaacttcgatatgtgtgcctaattattcacaaaatagaaactcacatgaaaagaatgatttgcaggtgcaatgtaatattattactttttcagctagttgtaattctgcaaaaaagagtgaaatttaatgctaatttaatctattcttggaacaatttcatggttgaatatgacagataaagagtcccacattcaaacaaataacattttgtaaacttacaataattttgatacaacaagaaacatttctgacccagattttgtggtacacagatggataaagagatatgtaaatacatagatagctggcaaacagatggcttttttttttttcctttttttttttaaacactggttgaaagtagccttccactgatgcatttttgcatgttgtaatatttaatattataataaagtgaggtagaaattcatagaagaggtagaaagtatataagtttaaaagtaagaatcactattctatttttgaaatattattgtatcacaactaataaaatgcaggcgtagatttgagaagaaattatacccacacattacttatttcttgtttactacaactcttcaaagcaaatttggatcttcacacacttaagcactgtcccatgagtaaaactgaatgtatttagcttatccatttcaattcaaaatctgatctattgatattttccagcgcttagagattttttaaagaacacagttttgttgttagcatctgcaaaaataaagcacatctaaaataaaaagtgtaaagttttccatattataaagtatggagtagtagtttaaatggttatttcagcattattaataaacagacagtatattaaaatattatgcagttgaattttttaaatattacataaattaaatacatacatacactctttttccttatgcttatttgtatatttcaaatttcactcagtttcttaagagtggccatgccactacatctggaatgactatttctatgtgtattttaatcttatgcattatttcagggctccttcataaattcatgctccctgtaactcacacttaatttttttttcgttgttgtaagtactatagttctcaaaatatcatcaatatgcttttgaactttatctttttaaaacaatattacactcacaatttttaatttatataaatatacagtacactatgaatttaaggacataaattatgttcttgaatcctagtaaatgtgttatgtattgatgctaatttatatatttttatggatcatggttttatgtaagttatttccattcatagtatatataacaatacaccatattcagtgtgtaaacgataaggttgatttaaattctccaaattactgccttaaaaaatgtctactacttcgtcttgtgcactgtatattcaccagaaaatggtaatctagaagagagaataatgtggagactcaagaaaatcaaaatacgatacctgaaactatgcttattttcacttagttcaataacattaaaaacacaaaaggtaagattaataacctagaaagcaggttgttagaatatgtctgaactgaaacaccaaaacgtttttaaatagaataaaaatacaggaaaagatttaagccatatgaggcacagagaaacagcatagcatgcatgtaatgggaggctctgagggaaaggaaagagagagatcagggcagaaccaatattttaggataaaatggctaaatgtttttgaaactgatgaaagaaacaaatccaaagattaaagaattatgtgaaattgtgtgcattatatgaaagaattatgtgagagaaagaatctctgtgaattccaagtagagtaaatagaaaaaaaacagtaaaactgtggaaaacaaaaaaagaataaataagcttaatggtaaccagaaaaagacatattaccttcaaaggtataacagtcagactaaggtctaacctctgaaaagcaagattgttttctttcagaaaacaatgtaagggaaagctaaattcctgaaatatgctattatggagtctagacatgaaatcatggtaactttcatcaaattgatgggaagatgaagaagagggaaacaatataaaatagattttagaggtgaagtagacgggacatgatgaatcacttcttggaggaaaagtaaagagaaaaatgaaatcaaatacgaagtctaggtttttcctttttcactgtcattttaaccaagcagccaatcccaattacaaattttagtaggtctgaggcagagtatatgggaggaaaaaatggataattagggttagttatattgagtttgagaggcatattagataactaagtaaacagatctataaatattttttttcagtagcgagggcgaattgtaggaggattaaatttaaacatggaggtcaggagggtttcactgaagtggtgttttgatagagtggagttttgttcttaattcattattcccctgcaatgtataaggtaagataatacggtcacagattttgccttgtaattgcagtgtctcctactgaagagagagaatacgttctggtcacactgatgtaggcgctgctatgttattttctccatctaatgctttgtggtttgccctgtctagtgtgtgcaacttgaaataaagtataaatatggatacatggctcagtttatcttcttgatacctaccacaaaaggaacatgtcttgagaacctgcttgtcacagaataacagaagtggaattgacctatgtattagtccattctctcgctgctatgaagaaatgggtaactataaagaaagagatttaattgactaacacttctgcatggctggggaggcctcaggaaatttacaatcatagtggaaggggaagcaaacacattcttcttcacatggtggcaggaaagagacctgtggagcaaagagggaaaagccccttataaaaccatcagatctcgtgagaactcactatcacaataatagcatgggagaaaccatccccatgattcagttacctcccacggggtctttctcatgacatgtgggggttacgggacctacaattcaagatttgggtagggacacatccaaaccatatcacctaacccaacttgcagcctggatctaaacacagttgaatttaatctaagtcattcagattccagagggacccctagaccagcatgtttgtgagcataggaatgtctcctttataagtctctgacaattttagttgatttttatgtaaaaaaaaatgattaatgggaactttgttactggagttgggatgttgctattctaatacaaactcaaatatgtgccattggcttgggtctgggcagtgggaagtgagaaaactctgataagaggatataaaaatagcaacacataacaacgcggtgagagtttggcatggtttgcacctgtggtaacttaggggtgataacaagcacttgtggaaatgaacaaggaagttttgaagcaaaatactgatagatagtgctggttgtctgcttgatagttgtgcttattaaagtagtagaaaacgtgataggaaagaactgacttctatgctaagaatagcatgactgaatagagagatcacagaaattctcagactttctgagtggtaatgaactagttcctgccaagtaaaaatgaacatattaaatcttgaactcaagggaaagttcaaatttagtgtcaatttcagacttccatcctagccttaggatagaaaccacatcaaggttgtggtcattaagattaatagataccctttcacttggacataaggaatcctaaaagactacagactgtctcatgaagccttttgtgttgtcaaatttttacttatagagagagagagagagagaacaagaacttgagagacagagaagaagaaagaataaattctcggtataacttttgacatttaaaatgaaatataatgaaatgcatagagtgcttcaaagtttttattaagttgcattggcctacttactaccaatctgcactaaaagacattgaggctattcaagatattaaaagacttgcatgtctatgaagcagcttcagagaacttcttagttccacaggaggacacatttcccaccactctctccagatgtggcaaaaggggacaatggaaaaaaagaaaggacaccagaagatagagagcaagtcaaagaaattaataggctggggaaagaagttaagggagcagaacacggatttaatcaagggaagaaaggcctcataaaatctgggaacagtgtaaggtgacctcacaaaattgatccagtgggatttgagaattaccatgaactagtgacttctaaattcctccctttcttttcatttttgaatgggagtgtttaatgtgctcctcctgtccctgtttcactattctaaattaggtgtggagaggggagatagaacttgtattttatttcatgtgtctctgtattaagagaatccaattctggatgtgacaaagatcactgaggagttcatgaagatatagagatgaattgtaatgcagccaaacctaagatagccattttaagccatattagactaatgggagtctatcatgaaaatacctgtaggaagaggttccaggcatatgaaatatcaaatacccagaatctgacataatattatgcctgcatttgcaagaaatagctcagaatttaatatggctagattagattaaacaagagaattaatagaagggagatgaagaaagggaggatggaaaatcacaatttaaagttttatataggttcttgctagaattttagctttcacctaaacagaaaatataacaatgtggatagagtggaaaagcatttgaaagattttgaatactagtaacataatatgacttatcatttaagatttcttcatcttgctgaagggacaagtgaagaatcaaggtgactaattataatccaggcaagagatgtgccccattggtgtattgatgataagtgcttagatgttggggtatattttgaaggttaagctttcataaattgttggtcgagttttttgtaatgtgaataaaaaataaaaacaggcaagggtagtagcaaaatttctggactaatttaaagcatagaatgaccaataatcaaagtaaggatgaacaacagcaggaagagttttcatttgtatgtacgtatgcatgtatgtatgcatgtatgtatgtgtgtattggggatgtggttagtgttcagaaactcgtttttacccacagtcagtttgagttacttgtgaaatatccatgcaaaatattaagcatgctatttggaatatcagtttgggatctaggggagatacctgagatgaaaatatatatgtttaggagttgtctttaggtggtatttgaaaccagaagattgtgtaaaataattagaaggtaaagaattggtgccgccctttaaagactagatcccagagcatttcaaagtcaaaagtgaaagtgattttttaaaaatgcaaagtagtttgatattgaacatagtggtataggaggaaaagaaagacgttaaaatatgaaagacaccgattgataaggtgataatcgactgaatgaaatgctcttgcaatgtcaaataagatgtgtaataaagaaaactcaccattagatttagcaacatttgtcagtgacttctatattgatagattttggccaactcagtttcagtgacgtggtgaggggaaaaaatctgattgggatggtggtttctcaacaaaaggtaaaaggggcaagagatgtgaaggtgaggtgaggatgtaattgtagttatgtgctatgaaatttaatcctgctaagaatacatataagaaggtagttgatacagacaaaagctgttatgaccaatggagtttaggtctagttaagtttaaaattgttgttgttgtttgcttacttgtttctggaaatatgagataatgagataggatgatagaaagtgataatcaacagctggatacttaagaagacatgactcctaaatataatgtgatatcctggatgggatcttgggagaaaacaaaacgaaacaaagcaaaagagacattaaattaaaactaaagaaacataaataaattataaactttatgcaataatagtgcatcaatattggctcattaattataacaaatattccaaactaatgtaagacattaataatattgcaactggagtacataaaaactctaccaccactgaaattcttttgtaatctgaaatgattataaactttaaagttatcttacctagcactttgggaggctgaggagggcaaatgacttgaggccaggagtttgagaccagcctggccaacatggtaagaccttgtttctactaaaaatgccaaaagttagccaggcatggtggtgtgtgccagttgtcccagctattcaggaggctgaggcatgagaattgcttaaacctggaagcagaggttgcagtgagccgagatcaagccattgtgctccagtctgggtgacggagcaagactgtatatatatacatgtatatgcccgtatatacctacatatgcatatatacatgtatatatatacatacatacatacgtacatatgtatattataaactttatgcaataaatatatacatatgtgtatatatctatatatctatatacatacatatatgtatgtatatatacagaatacatagattttatatatattttatatatacatatatatgcatatatgtgtgtttgtatatttgtatgtgtgtatatatatgtatgtgtgtgtatgtgtatatatatgtatctatatatataaagtaggaatcctgaacccaatgaaaccaatactggtttcaggtactggcgataatgaaatgaatgacgaaagatgataagagcatgtggctgaagtataatggaggacaacttctccagaactgaagttgtcaaggagctgagagttcagcaaattagaaggactatgtggataatgaaataagcaaaatatttcatgagcagttttggatcaaatgacaatgaaattggagctaaacttttaaagaaatgaatgggaacaagttggatgtctttagtagggtggcatgtgggttggtgaaatttgataaaatgaggtaggacatgggtgatggtaatgcgatagggaggaagaaagttctggaagcagagtgcaaagtcaggagaaaactcatttatctccagatccatgctatcaggaatgggaaagaaaatcacaccattagagagagttgaaagagaacttatgtcatcagagggtagccacattgtagagcgaatggtgaagaggagaatttgaggatatagagatttttcagaacgctaactgagagttaaaaatggcaaagagaaaatattttaggagttggaatacttgggagaagggtcttataaaaggcaactttagagttgtatttaaagcctgggactgaaggatgcttaagatgtcctcggcttcttgtgatgtctgagatgaactgggatagtcttaattaactgggttaattgtggattcctaaagctaagaggtagaatgagtctataaccattggcacataggcgagcttgctagaagcactcagagtattgacagtcactctttgcttctgcttctggttgttcagaaggtggtggtgaagtgctgtctttaaacacataaggtttttctcttgctctttgtctatcggggagcacagatcatggtgggccaaatatataaatttggagccagggaagacataaggactcagaatgaatatctggttgtcataagccgtggtgtttaaagcctgcagctggatgaggttgcctatcatgacagttaaaactgcagggaaaagaaggggacgcagggcaatccccagacaaggctgggtagagatgaggaagaggagtggaaaagcatgagaagaatacatactgaactcacgaaaaattgattattagaatatgccctcatctcctctagccctcgcttgatctattgtgtttgcatggagcaacaaaatcttaattaaaatcaattacctaacaacccttgcccacaaagctaatggtagctagaggaaaacagttaccctgcttggttgctccttgctttcacaaacacaagcattctgccctaaaagcatacgaattacttagtccatccactcctccgttctcgtacccagctaattcatagtttttttttgtttttttgtttttttgttttttttttgagacggagtctcgctctgtcgcccaggctggagtgcagtggcgcgatctcggctcactgcaagctccgcctcccgggttcacgccattctcctgcctcagcctcccgagtagctgggactacaggcgcccgccaccacgccctgagaatttttttgtatttttagtagagacagggtttcaccgtgttagccaggatggtctcgatctcctgacctcgtgatctgcccgcctcggcctcccagagtgctgggattacaggcgtgagccaacacgcccggctaattcatagttttaactctttcttaaatcttcccaaactcctactctgtccttcctcccagatcaagaccatgcatcttatttcacagagaaaatgtaagcaattaggaaagaatcccctatggtatctcttctcatgtgttctgactttctttgcaaacctttctgtgtatccatctaagaaaaatctctttacttatgcactacatcccattttctgtctcaattttaagacattttctctctctatctcatttaataacaaatttgttctctccacttgatcagtagtaccaggatcaaccatgtcattatttctcacatgtaggaatgacttggttccctttccctccaagtagttcctcagttctctgatcccctttacagcaaacttattcctagtgtctagaacactttttacacagttttccatatagtttagtttcctactcccatcattgtctttcttccttcaggcctttcctcaaatatctgcttttagattcagatttccatgatcatcctttagaaaattgctcattctccaggttttatgacagatacctccctgtccttctttatagcacctgatatatatttttatttatttgttagtgtgtgtgtgttttgttccctgacatggccccagcatctagaacaaaacctgtaattattaagtactctagttaattgcatgaataaataaaaactttaacaagtgagtgtaacagaacttaaaacaataatctcaataaggaaggagctaaggattcaagcagattaagacagggatattctccttaaatatcagtgtgcttgctggtgatgtaagaaaacgccacccagagagtgaaggtcatggcatcctaactggaggtacaggcctgaggaaagaaaaatataagataacagagaggaatctggccaaaatgatttttttaaaaaaagaaatttcagtgagaagaggagtaggatattacagcagtagctgaaaaggaatgttgacaagttttctatttttttagattaaatttgattttatgctgatgaaattcttatatatttatggaactttattttctcctcaatatcagaatcaattaataaataaaacacacgtgtcagaaaagtaaacattaaagtgttagctgtataagtaataagttgattggataattttctctaaatctacagggaaaaggcgagaagtcaaataatattttctgtctgcaccagtctagattttgggacagaacatctgaaaaacagattgggtcttggatatagatctgaataatcaggattgtgacctgaatctggtctgaaaaagagagaaaaccaaagtagcaaattacctaggtttgtaaattttaaggatagatagctctgttcagcagagaaaagtggattgaaaggtaagaaagaaaagtggatagacaaatctcaccaataaagaaactgtttccttcttcctgaggaccaaagacattactctaggggagctctcttcgtttagaaacatgaagataagggaaaagatgttcctcttccaaaaggaatgatttggtaaacaaggagaaattaatgatacagtttaaggagatatgattgcaggagaaaatatttaaatagattaagagaagatagaatgcaaagcataaacagaagtcttggcttaatagcccagctgcgagtgagttgttagatttggtggtagtgagaagagggaatactcctccgtttgcttcaatctactaattaaaacaggtaatgaaggcagccatttggagtatagaggcaggtttgtggatggataagaattacaagggggagtgatgaataaaagttactgaggaaatataaaagaaattctgcatagggttaagaggccttttgaaatttctgttcattaatttcaaatgagactagtcagcatttttatgtgattttttaaagtcttggaacatattgctgcttgtataaatttgcagaataggcagatattataagcaggtttgcagttttggttggtgggaattatggaggaagagatgggacaagaggcttagtagtgtttgcaaataaattattaaaatattggtccatataatttagacaacataaggagtgaagtaaaaatgtgagaaaagtgagtggaggtggtgaagcatacaaattaaagtaaaaaaaactgaagattttaatgtggttaaaaaagttgttggaataagcaaggatgagagaaactgctggtcacatagtggcaagcttatatgacaggattccagatgtgttacagagtttgatgataacaagggcaggattatacaagttgatggttggagtacggtggaaagaaagaaatatgattggatatgaaaagcttaagttattgaaaattcatagactgatagagatcatctactggattgtgatgtcatcaagagtaagaatagtaagcatgtggagaaggaataactcaaattctaaaagttgcattaataaaaagctaaaactgcccaagggttagaaaatgatactcacatgaaacaccataattagtatcatctaaagttatccacctcaaaaagctggtaaatatttgtttttgaaatgataaggaaatcttttagacaatgacagaaacttgtattgatttgcattggtgaggatgtcaaggacaacgatgaatatccagagtaataatgaataacagtttcttatatctgatttgaacatacacgctccccaaagttttgccagctacttgactttgttataaaatcttagccaatatcatgtatctggttaaggcagtttccttgccactcagcctccattgttgggaagaaacttataaaaaataagaagcactgggctggatactggaggtacattgaaagtcagtctctgtcctgaaaaatctcacattctagtgggtgaagtagacattattcaatttatcacatcattaaatgtaaaactggacacttctcctgggaaacattactgtttacaaataaagtgacaatctagctgcaaccagttgtataaacatgggattactttttagaactacagttgttccaagtgtgtcacttttacaataggaaagaaatccagtgttgacacagcataaaattctagtaaagggtgagagaccattttttatactacagtagattagatatatatgcccttcaaaaagaaaaactgttgtgttagaaaaacacttcacactttagggtcgtcgaaagatgtggaaaaatatgtttaagctccatggtttagctgtaaggaaaataaaggaaatcataagagataaaattgagagactagagaaaatccagagaggtatttcaatgatgaaactattgactctgctaaggcctactgaaggagagtttgaagtttatgtctgaacagggactagtgggaaaaaatacttttggttctgaggaatcaaaaagttttaaggcctagtctcaaaaataatagatcattattatatgggaatgactaacaagtttgaccatatatagtatgcgaggcaccattctaagaaaattgacttaaaatcagttaatctcccaaataaccataataactcagatttttggaatgtagaaattgaagtagagaaagttaggtaagctgctcaaaatcacatatttagtacatggtggaattatgtttcaacctcagccatccaggttaacctagattgctaggtccacatttcgtctaggtccacatttcatctctagtctatattgttgctcagctagaggaaaataaaaaatatgctcaagaaaataaaaataacaactctacaaatggaaatggtaatggatattatctgtctcaggcctagctatatgtaaagtgtttaaaaaacaaatgcctgagaattttaaattatcatcaggtgatttttgaatctgaatataaaataccgtttggtccacaaataagcaaattattgattttgcaagtttcttgtattggcagtactttcaggagttaatatggaaacaaataaatctcatcttggaaggaaagcaccctcagcccaggactcagtttccaaagatgaagctaaattgaacctctgttgagaaaaataaagtagatcagtaaatcaatgagaaagacattggtcctcatcacttattgtcaacataaataataaattccaccactagatttgcaaagatttaagatatttggacaacaaaatacataatacaaaatatgtgtcttaattggtttacaatataaaagatatcaaaccatgactaagaaaaaaaaagaggttaacaacaatggcaagctatttcaaaatacaaacaaatgtaatttgttgaagtgatctatatatttatgtgtgtatgtgttcccgtgttaaggttagaaatacaatgagtggtttaaatagtagttgaggtgccattaaagagagaattagtaaacttaaaaacaaaattgaaggtataagcctaaatgcatataggagaaacaagcatatttaaaatgtgaaatttaaatgagattgcagaagagtacagtaagagtgtgactttaaattagtcctagacgctggcagtagagacattggaagaaggtgaaatttgaagataaagtacatcagtatttctcagaatcagtaagactttaaacttaagattcagaaagcttcacaggtcccaaacaggataaaaattaatctacaactagcaatatttatcatgaaactgtaccacagtgaagccaaaaagaagattgtaaaagtaataagaagtacaaaaaactacgacaaataattttcaaactgcataagtggaagacagagtatatagtacatcttcaaagtgctgagagaaaataatttttatattaaaaatttaacaggagcaaatttaccaccaatatctcctaactaaaaaaactgtaaagctcatttgaaaaaatatatttaaacaaaaagtatcactaggaattaatgtgatcccacataatattaaactgtgtaattcaccctgcagatataatatgttgggcattttacatatataacaagataacttcaaattaagtaaaactagaagtaacagaattaacaggagacttaataaatccgtcttccgagagaagaattaaatgcaagtccctcaataattgagagatcaaacagaagaaaaaaaattatagatacatacatatttgaataatgaaattaacatgcataaaatatcccacataaggaatggcaaacctgaaaattcaaaaatacacatttcatgcatatatttaacattcaaacaagcccaatacaaatattaaagaatcaggattatgtcatattgactatgttctctaaacaaaatataactgattttaaaaggaattaaagataaaatatatctaaatagaaaaaatgcttctgtgtaattattaagaaggctgtcggctggtgcagtggctcacctttggaaggccgaggtgggtggatcagctgaggtcagaaattcaagaccagcctgaccaacatggtgaaaccccatctctactaaaaatacaaaaatcagccaggcgtggtggtgcatgcctgtggtcccagctacttgggagactgaggcaggagaatcgcttgaactcgggaggtggaggttgcagtgagttgagatcacgccattgtactccagcctgggcaacaagagcaaaactccatctcaaaaagaaaacaaacaaacaaacaaaaaactacgtaacagatataatagatattagaaaatacacgtgaagaataataaaagtattaacttttaaaacaggtaagattcagtgcaagaagtatttagagggagattagaattgtaaatgcctacatctataaaaaataaaattaaacacttgatagatatgatcctgaggtggcaatggaagtgtgttgcttagatcttgttcaagcgaatcttctgcaaggagattaggtactggacagactccagcctctgtactgttggacctgccgcccccaccgtattatgccaaggactctttttccctgtgcttctcacagacaatgactgaacacaacggggatgctggagctgggccatacttgcccaagacattccttcacagcacaggcattttttaaactctgtctccgtgtacctggcctgcctgagactcctactacctaatccttccttcatcagtctctcacttcagagaagtcaatgcttcatgatagtctgatgctggattctcacagcctgcttctgactcatcttcccttcatccttcacagtcaagagtggctccacgataactggcaaggacaacttaccctgatcaacaggaggaagtagtgcagcttttacacaatggaggccaggggaaatactgtaatttcatgagatccacattggctccacttgatactcacttgttcaagtgttgcagtgaatggacacatgctgtagtccaggtctgagaatggtacaattgattaccaagggttccttttcctcatgaataggagtttgagctagaccaccaaggacaccatatgaactcttcagtaagatcaagaggctatcactgagggtgacagtatttacaaggcacacttaaaaagtgagataacagctttaagacaagttgcagtaatgtgggcttagttctttccagaagctctctctaatacttttccatcatgaaaaaaaggcctatgacaaatatagatgtgtgctgctttccaaaaatgtttgagaaagaggatctgtgtgttgcaagggatcgattgcggtgcgatgggaggtgtagccctcatatttctctccaagcacacctcctacaaggaggggaattggcttccagctgtctcatgcttctatctgccacaacattcacttcaaggtcacactctccctggtcttttcagagccaataacgttatgacagtggtatgatggtgggactgttcctgcccaatatgggactctatttggcaatctttgctctgaggtttcccatcatcctgcctgagactgtcccagagctgtactttagtctgaagctccccttacccaatcctccttcctgtcactctcctttcacaggtgtaagatgtgtaccataatctgaagttcttctctgcttgatcctgatccttctcacataatcttcataggtattttctcagaatagatcttgcctgtacacatctaccttgacacctgctcctcataagacatgatttgaaaacatccaactcaagaaagtcaagacaaaactaaaagacacaatatacccaaagaaattaaaagcaaaaaagtcaaaattaataatcaaatggaatacaaaattgaaataggctcactcaaacgaaattatttcttgaaagtattaccaaaactgttgatattcaatcaaggttgatgaaataaaaacaaattatgtagaaataaactatgaaataaaatcaaccacactactattgaacacagccctttatccataatgttacaacctgaggtcaactataagggagctctttctgtgctttgggaagtaaaggcagaattttagatttagccagggatgataactaatgttcatctactttgggacatagttgtccaaaatttttttcagaaatagagttgttcttggagttatcagccatttggttaggtatttggggatagcaagagaggttggaagaatcagtagaggctgtgatcacctgagggtcacacagggaaatcttaagaaactaagaggaacacaaaagaaaaataaaaatcataagcaatgaagtaggctgacatctatgatagcccccaatgatctctgcctcctggtattcaaacccttgtataatttcctcctcttgagtgtgagctggaccaagaaactgttttctaacacatagaatatgacagcattcttggaatatcacttctatgattaggttacaaacttcccagagcagaaacctataaatagaaacctctgtgggaaccagtgccttggtagggaaacctaaactgtgattgatgaattgctatcagttcagtgtggacaagtctgagagataaaatctctgggggaatccagtcatcaggggccctgagatttttatcaattttaccttttggagatttaccacattctcacagtgaatatcagagacaatttccttcatgcttccagcagaagaaagggaaaataaactatttggaaatattccagagcattctgctcttcttaacaaagtctggcctcaagaggaaaaactattgaattagagcctaacctgctggggttttccaaacctaactgacctgagaaaaggaaaatacccaaatccagttggttctagcttttaatttggagggagggaaatactcaattccagccctctctagccttccatgtaggagaaataatatactatctccagctccctccagcctgtcccactaatgaggagaaggtgactgagaagcacttacaaagttaacagtctagaagcagagaattgctgaaagactgagacctagtcatggaaccgaagactacttttcctgtggccacccgcacccccccatatcttatcatcacattataacagccctatttacaatagtttcttttattaagtatatcacgactggctatcaagaaaaattaagaagggatacgaaatggcaaaaacacatagtttaaggaaacagaacaagtgaaagaaccagaccctgatatggtagggatgttggaattatcaaacttgtaaaacaaaacagctacaattaataagtcagagggctccaacagatttaaaatagactgcatgcaagaacagttgaacaatgtaagcagagagatggaaattctaagaaagaattttaaaaatgctagacatcagaaactgcaacagaaatgaagaatgactttgatggacttatttgtagactgaaatttctgagcttgaagatatctcaacagaaaactccaaaactggaaagcaaagaaaaaagaatgaaaaaaaaaagcccatagcagtacatccaagaactgtagggcaactacagaagatataatatatgtatgtagggtgtaacaccagaagaagaagaaaatgaaaaaggaacagaggaatacttgaaatgcaggaacataaattagtacaacaactatggaaagcagtatggagagtcttcaaaaatttaaaattagaaatagaaccatgaaattctctagcaatcccactactgaatatatatatatatatatatatatatatatatatatatatatataatgaaatacatatgtcaaaaagatattggcacttccatgttttttgcagcattattcacaatagtcaagaagataaggaatcaatgtaagtgtctatcaatggataaatggttaaaaaatgtgataggcacacacacatacacacacacacacagtggagtgctattcagccttaaaaaagaaggaaattctgtcatttgtaacaacataagtaagtctggagaacagtgttatattaagttaaataagtcaggcacagaaagacaaatactgcatgatatcacttaaatgtggaatgtaaaaattaaactcatagaaacagagtgttattaataaataggggttcagaggaagaggatcatggttttcagaagacattcgtcataggacaccaaattttagttaaataggaagaataaattcaaaggatctattgtacagcatggtgactacagataatagcaatatactgtacacttgaacatctatgagagtgtagattgcaaatgctgtcactgcacacaaaaaaacaagtatgtgaggtaatacacaggttaataagcttgacttagctattttataatgcatacatatatcaaaacaacaggttttataccataaatatatacctttttgtcaatttaaaaagaaataaaagagaaacattactacaggtcccaaggacattaaaagcaaaataaaggaatacaatactatgtactattctatgcccacaaattttataactacaaggaaataaaacaatttctgtgaggatacaagctaacaaagctcacaagagaagaaataaacattacacatattgaataaattgaaacaagaattaataacattccaaaacagaaagcacaaggcccaattcgattcattgatgaattcggcagcatgttatttaatacaagaagaaattatatgaattatgtacaatttcttccagaagacaaattacttctgagagattatgaattccttctaggagacatcaccttaatacccaagccagagtaagacattacatgataatacaattatagatgactgtcactcctgaacatagatgcagaaatctttgacaaaatattaacaaatagaacccaataatacagattacaaaattgtacactatgactaagatttatttcacatatgcaaagctggttcagtattgataaatcaactaatgtaactgatcacatcaacaggctaaggaggaaaaattgcttgtttatatcaatagaatcaggaaaggtatttgacaaaagaacatgactctcagcaaatcagaaaaagagaaaaactttctcagcttgataaatatctacaaaaaaacaaaaaccacacaccaaaactaatggtgagaaaacagaagcttttccaacaagatcaggaaaaaggtgaagatgttccttatgacctctgctttttcacctcatactgaagaagcaaaagattcaaaatacccagcaaaatgctgaaagggaaaagagactgaggaatgacacacttcccaacctcaagacttactataaagctaaagtaagcaagacagtatagtattagagaaataactgacaaatagatcaatgaaacatgaaaaagctcagaaatacacttacataaatagaattaatttatctttgacaaaggagcaaagacaatataatagagaaaagatagttctttcaacaaatggtggaacaactaaacgttcacaggaaaaaataaaaataaataaatccagatgcagatcttacacgcctcataaaattaattcaaaatggatcatagacccaaatgtaaaatgcaaaactataaaactcttaaaagataatgcaggagaaaacggctgtgatgacttcctggaatggtgatgactttttagattatgacaacaaaggcatgagccatgaaagaaataattgataaggtgaactaaattaaaatgaaaaacttctgctctgtgcatgacaatgtcaagagaatgaaaagacaagccacagaacagaaaacaaggtttgccaaagatacatctaatgaaggatgcttatccaaaatgtaaaagtaccacttggccgggtgtggtggtttacctgtaatcccagcacttagggaggccgaggtaggttgattgcttgagctcaggagttcaagaccagcctgggcaacatggcaaaaccctgtctctacaaaaaatatataaaaattagcctggtgtggtggcacatgcctatagtcccagctgcttcctggggctgaggtgggaggatcacttaagcccagatagttgaggctgcagtaagccaagattgtgccagtgcactacatccagggtgacgaagttagactctatctcaaaaataaaataaaataaaataaaataaaataaaataaaataaaataaaatgtcttaaaattcaacaataaataatctaatttaaaaatgggttaaaaaccttatcaaatacctcatcaaaatacatagtaatggcaaataagcatgggaaaagatgctccttaacatacatcatcaggaaaagccaaatttaaaaaaccatgagatatcatcaaacatctattagaatggccaaaactcagaagactgacaatgccaaatgctgataaaaatgtgaccaatgaaatctccaattcattgctgctggaatttcagaattgtacagtcctattagaggacatttggtgacttctttcaaaactaaacataatcttaccttacaatatagccattgcactggttgctatttacccccaaaagttgaacatttatgtccacacacatgtttacataagttttattcataattttcaaagcttagaggcaagcaagatgcccttcagtaagtgaatggagaaagaaaccatcaaactcagacaatgaactattattcagtgacaaaaagaaatgagccaggaaaagacatggagaaacttaatattttgtcttagtctattttctgttgcttattacatagttattgacattaggtaatttataagaaaaaatgactttattttatgactttatttatggaagccgagaggttcaaggtcaaagggcaacttctgatgagggcctgcttgctggcagggaccctcagcagagtcttgaggtggtacagagcatcacatggtgaggggactaagcatgctagataatgtctcttttcctcttctcataaagccgttaaaactaatgccatgataactcattattccaccaacccactaatttattaacctgtgaatggattaatccattcatgagagcagagccctcatgattcagtcacttgttaaaggcccccgtttttcaatgctgccacatttcaacaagaattttggagggaataaacatgcaaactacaacagcataatactaagtaaaagaagtccatctaaaaaggctacgtaagcatatgaatatatgctagatatcataggtcatcagagaaaggaagattagaactgcaatgagatatcactacatacctattcaaatgttcaaaatctagaacattgacaacaccaaatgatggcaaggatgtcaaacaacaaagactcattcattgatgatggaatgcaaatttctacagccactttgaaagacaatttagcagtttcgtataagaataaacacgcttttagcatataatgcagtgtttatgctccttgctatatcaacaggaggaaaacatgtccacagaaaaccctgaaagtgaatgttgatagcaactgcattcataattgctgaaacttttaagcaactgctatggtttggatgtggtttgtggccaccaaaactcactgacatttgatctgtcgaggtaatgttgggaagtggtaatgttaggaagtggcaatgttgggaggtggcagtgctgggaagtgaggttattggaagttatttaagtcataggagtagatcccacaagactagattaatctcctccctcagaggtgaatgagttctcactcttgtgataataatttagtcccctaaaacacaggttgttaaagggtctggcttcttcagtttttcttgctccctgtcttgccatgtgtgatctctttgtatgagccaatctgttttctgctatgagttgaagcctcatgaggcactcaccagatgtagctgctattcttggactttgcagccactggaatcatgagccaaataaatctcttatttaaataaattacccagcctcaggtattctgttatagcaacacaaatgtactaagacaacaaccaagatgtccttcaggaggtggatggataaactgcaatacatccagccaatgagttatcaagacatgaaaagacatgagggaacataaatgcatattactagcttttcaaaactactctgaaaaggctacatattgtatgattccaattataagatattctagaaaagacaaactgtggagacataaaaacatccgtgggttccagggattaggagagggagaaatgaataaacagactatagaggattcttagggcatcaaatgtagtccgtaaaatactataatcatggctacaattgttatacatttcttcaaacctataggtgtatattaccaagctgaacccttacataactattgactttgggtgataatgatgtgtcaatgtgagttcatctgttataacaaatgtactactctgatggattacagtgataatgggggaagttatccatgtttgtaggtggaggggcaaggagtattcgagaattctccataccttctattcaattttgctgtgaatctaagcattttaaataatttgaatttattttgcatctacaaaactgaaagaatgatcattttaataaatgaaaaatgcatattaatgacttaatagtcaacattgtaatctgtagcattgtgaaagatctatgaactctacaatcatgcacacctgtatttaaggctttctgtgccatatgatttttaagactatgggcaaagatttaacctttgtgaccatcgatttgcccacacataatagcaagatcaaaataacacctgagaattgaagggaaagataatgagatggaaagtttaggtaatatagatgcaggatgaaaaaaggccttaatatacattaatttcctgctaactacatcttcaaaatctatttattaggcgctgaaactatttttatttcaagttgaaatttgacatttagattttctaaatctctgcttttatttggaaagttattagccccctagaattaacaatcaaaggaaaacctttacccagcatagttacagggtggaatgtataattcaataatgttttcactgaaattaattaaaattcatcttacttatgtagtcaaatttcttctgcaaagatatttcagaacctgcttacagccattcactgggtgatttgtcaattgcttttttgtttattttttaaagaacattttgagaaaggtctcatgtaaatacataattatgttttcctgagaatttttcagaataaacagagagggaaaattaaattcttcacaagtagaaggccaagcattcactgacagttcaataatgatagacatttctgaattaaatgtttaatataaatgtagaaagtgaaaggaagttgtgtaaaataatgtgtcagctttaaagaacctggtaactgttcaaggattaaaaacaaaataattgttaaagttgctcttcaatctctaagctaaatgaagaaagcctcaaaatctgctgagtaacaaggcagagagtgccagaaattcctgagaaatgacatgtaaatgagttagctaggtaatggctggaatgcctaggttgcaacctcctcatatagatcttgttgttttgtagatgccatgtttcttatttaactaccttctgttaaacatctagattatatctaatcctttcctagaaggtttttacatactttttaacatacgtaattattcaaactttaattgccttctaaagttacacatggactgtggtttcactatagttcctaaaactgagtactccattactttgatttttttttttagttttttgtatctaccattcaatccaacaatcccaacaactaggtatctacccaaagaaaaataagtcattaaataaaaaagacacctgcatttgtatgtttattgtagtacaatttacacataaaatatatggaatcaacctaagtaccaaactaccaataagtggataaagaaaatgtggtatacttataccatggaatactacttagccacaaaaaagataaaaataatgtcttttgcagcaagttgggtggaattggaagctattatcctaagtgaagtaacgcaggaacagaaaaaccaaatactacatgtttttacctataaatgggagctaagctctggatatgaaaaggcatacagaattgtataatgaacattggagactcagaagggggaagggtgggagaagggtgagagattaaaaatcacctattgtgtgcaatgtacactattcaggggaggggtacaccaaaagcccagacttcaccatgttacaatttatccatataagaaaaaaccagttgtacccctaaagttattgaaatttataaaaagaaaaaagctgtaattttaaagatatttctttatagcagaatgacattaaaagtattgaaaattctacatgaaaatatgatagcagatttcctacttagtttacattgactaaaaccaggtggataatttagaagctaataccaagaaatagtaacattattttgcattattttttaaatgttctgttctttatatttaaatccagttaccaatattaatgttgttaatgttgaaaatatgagtatctgttttgttgtagctatatgtcaggcctctgaccccaagctaagccatcatatcccctgtgacctgcacgtacacatccagatggctggttcctgccttaactgatgacattccaccactaaggaaatgaaaatggccagttcctgccttaactgatggcattatcttgtgaaattccttctcctggctcatcctggctcaaaagctcccctactgagcaccttgtgacccccactcctgcccaccagagaacaacccccgtttgactgtaattttcctttacctacccaaatcttataaaacggccccacccctatctcccttcgctgactctctttttggactcagcccacctgcacccgggtgaaataaacagccttgttgctcacacaaaacctgtttggtggtctcttcacatggaagtgcatgaaatttggtgctgtgactcggatcgggggacctcccttgggagatcaatcccctgtcctcctgttctttgctccgtgaaaaagatccacctacgacctcaggtccttagacccaccagcccaaggaacatctcaccaatttaaaatcagctaagtggtctcttcatactctcttctccaacctctctcactatccctcaaccactttttcctttcaatcttggtgccacccttcaatctctcccttcgcttaatttcaattcttttcattttctggtatagacaaaggagacacattttatccgtggacccaaaactccggcgccggtcacggacttgggaaggcagacttcccttggtgtttaatcattgtagggatgcctctctgattattcacccatgtttcagaggtgtctcaccacgcagggatgcctgccttggtccttcacccttagcagcaagtcctgcttttctgggggaggggcaaggaacccgaccccttctctccctgtctctacccattctctgcttttctggggggcaagaaccccccaatcccttttttctgtgccctgatcccttatttctgtgccctgacctcttatctctgtgccccgatcccttatttccacaccccgacctcttatctctgcaccccatcccttatttccatgccccgacctcttatctctgcaccccaatcccttatttccgtgccccgacctcttttctctgtgcctcaaccccttatttccatgccctgaccccttttctgcttttctagggggcaagaaccccccaaccccttctctccgtgtctctactctctcttttctcttggtttgcctctttcgctatgggcaagcttccgccttccattcccccttcttctcaccttagcctgtgttcttaaaaacctaaaacctcttcaactcacacctgacctaaaacctaaatgccttattttcttctgcaatgccacttgaccccaatataaacttgacagtggttccaaatagccagaaaatggcactttcaatttttccatcctacaagatctaaataattcttgtcataaaatgggcaaacggtctgaggtgtctgatgtccaggcattcttttacacatcagtccctccctagtctctgttcccaatccaactcgtcccaaatattctgtctttccctcccacctgtcccctcagtcccaaccccaagtgtccctgagtctttctaatcttccttttctatggacccatttgacctctcccctccttgccaggctgagctaggtcccaattcttcctcagcctcttttcctccaccctataatccttttatcacctcccctcctcacacctggtctggcttacagttttgttccatgactagccctcccccacctgcccagcaatttcctcttaaaaaggtggctggagctaaaggcataagtcaaggttaatgctcctttttctttatcctaaatcagagagcgtttaggctctttttcatcaaatataaaaacccagcccagttcatggctcattttgcagcaaccctgagatgctttacagccctagaccctgaaaggtcaaaaggctgtcttattatcaatatacattttattacccaatctgctcctgacattaaataaaactccaaaaattaaattctggccctcaaaccccacaacaggacttaattaacctcaccttcaaggtgtacaataacagaaaaaagttgcaattccttgcctccacagtgagacaaaccccagccacatctccagcacacaagaacttccaaacgcctgaaccacagtggccaggcattcctccaggcccgcctcccccaggagcttgctacaagtgccagaaatttggccaccaggccaaggaatgcccacagcccaggtttcctcctaagccatgtcccatctgtatgggaccccactgaaaatcgaactgttcaactcagctggcagccactcccggagcccctggaactctggcccaaggctctctgactgactccttcccagatctccttgacttagtggctgaagactgacactgcccgattgcttcagaagacccctagaccatcagggacgccgagcttcgggtaactctcacagtggagggtaagtccgtccccttcttaatcaatacctaggctacccactccacattaccttcttttcaagggcctgtttcccttgcctccataactgttgtaggtattgatggccaggcttctaaacctcttaaaactccccaactctggtgccaacttagttatccccacctgcccagttcccttattaggctgagacactttaaataaattatctgcttccctgactattcatgggccacacctcattgctgcccttcttcccaatccaaaacttcctttgcatcctcctcttgtatacccccaccctaacccacaagtatgggatacctctactccctctttggcgaccgatcttgcaccccttaccatctcattaaaacctaatcactgttaccccactcaatgccaatatcccatcccacagcatgctttaaaaggattaaagcctgttatcactcacctgttacagcatggccttttaaagcttatgaactctccttacaattcccctgttttacctgtcctaaaaccagacaagacttacaggttagttcaggatctgctccttatcaatcaaattgttttgcctatccaccccatagtgccaaacccatttactctcctatcctcaatacctccctccacaacccattattctgttctagatctcaaacatgctttctttactattcctttgcacccttcatcccagcctctctttgctttcacttggactgaccctgacacccatcatgctcagcaaattacctgggctgtactgccgcaaggcttcacaggcagcccccattacttcagtcgagcccaaatttcttcctcatctgttacctatcttggtgtaactctcataaaaacacaagtgctctccctgctgatcatgtctagctgatctctcaaacttcaatcccttataaaacaacaactcctttccttcctaggcatggttagtgcagtcagaattcttacaaaagagccaggaccgcaccctgtagcctttctgtccaaacaacttcaccttactgttttagcctagccctcatgtctccgtgcagtggctgctaccactctaatacttttagaggccctcaaaatcacacactatgctcaactcactctctacagctctcataatttccaaaatctattttcttcctcacacctgacgcatatactttctgctccccagttccttcagctatactcactctttgttgagtgtcccacaattaccgttgttcctggcccagacgtcaatccggccacccacagtattctggataccacacctgaccctcatgattgcatctctctgatccacctgatgttcatcccgtttccccacatttccttcttccctgtttctcaccctgatcacacttgatttattgatggcagttccaccaggcgtaatcaccactcaccagcaaaggcaggctatgcaatagtatcttccacatctgttattgaggcgctctgcccccctccactacctctcagcaagccgaactagttgccttaactcaggccctcactcttgcaaaaggactacgcatcaatatttatattgactctaaatatgccttccatattgtgtaccaccatgcggtcatataggctgaaagaggtttccttactacacaagggtcctccatcgttaatacctctttaataaaaactctgctcaataccgctttacttccaaaggaagctggggtcattcactgcaaggggcatcaaaaggtgtcagatcccattgctccaggcaatgcttatgctgataaggtggctagacaagcagctacctctccaacttctgtccctcactgccagtttttctccttcacatcagtcactcccatctactcccctgctgaaacttccacctatcaatctcttcccacacaaggcaagtggttcttagaccaaggaaaatatctccttccagccttgattctattctgtcatcattttataacctcttccatgtaggttacaagctgttagcctgtctcttagaacctctcatttcctttccatcatggaaatctatcctcaagggatcacttctcagtgttccatttgctattctactacccctcagggattgttcaggccccctccctttcctacagatcaagctcagggatttgcccctgcccaggactggcaaattggctttactcacatgccccaagtcagaaaactaaaatatctcttagtctgggtagacactttcactggatgggtagaggcctttcccacagggtctgagaaggccgccgcggtcatttcttcccttctgtcagacataattcctcagtttggccttcccatctctctacagtctgataacggacaagcctttactagccaaatcacccaagtgctttctcaggctcttggtattcagtggaaacttcatatcccttaccatcctcaatcttcaggaaaggtagaacggactaatggtcttttaaagacacacctcaccaagctcagccaccaacttaaaaaggactggacaatactttcaccactttctcttctcagaaatcagacctgtcctcagaatgctacagggtacagcccatttgagctcctgtatggacgctcctttttattaagccccagtctcattccagacaccagaccaacttggactgtgccccaaaaaacttgtcatccctactatcttctgtctagtgatactcctattcaccgttctcaagtactcatacatgccctgctcttgtttacactgccagtttacactgtttctccaagtcatcacagctgatatctcctggtgctatccccaaactgccactcttaactcttgaagtaaataaataatctttgctggcaggactatgctgaatctccttaggcactctctaattagatgtcctgggtcctcccaattcttagacctttaatacctgtttttctccttctcttattccgtttagtttttcaactcatacaaaaccatatccaggctatcaccaataattctaaatgacaaatgtttcttctaacagtcccacaatatcaccccttaccacaaaatcttccttcagcttaatctctcccactataggttcccacgccacccctaatcccactcaaagcagccctgagaaacatcgcccattatctctccataccatcccccaaaattttcgccatcccaacactttaccactatttcattttatttttcttattaatataagaagacaggaatgtcaggcctctgagcccaagctaagccatcatatccccttgacctgcacgtacacatccagatggccggttcctgccttaactgatgacattccaccacaaaagaagtgaaaatggcctgttcctgccttaactgatgacattatcttgtgaaattccttctcctggctcatcctggctcaaaagctcccctactgagcacgttgtgacccccactcctgcccgccagagaagaacccccactttgactgtaattttcctttacctacccaaatcctataaaatggccccaccccatctcccttcgctgactctcttttcggactcagcccgcctgcatccaggtgaaataaacagccttgttgctcacacaaagcctgtttggtggtctcttcacctggatgcacatgaaactatatatagccgtgaaaatgttgtgatttatttttgatgacaatgtatgtattatcttctcaaatataactctcaatctgaaatttccgttaaagttctttaacagagcactgtataattttaaaacatctttaattttcagttcactatctgccaacttgtctctttctgaactcataacttttacaaatgatgaactttaattcctactatggccatattattacatgcatattcatttattgcaattttgtgtcataacattcgaaattatccacatcaattttgactcactcattactttagcattctagccaattaaatatgtaatatatacttgataatgttttattaccgggtaacatataaacaacaaaaaattacaatgttttacagttagagagagatagaaagagaaacttcaatagaatagagtggaagcctggaagaaggatcatttaaatgcatctgcaaacgagtcagtaggacttgtggggaggttaggcaatgcggaaacatgacatgaaaagaaatggaaagcagtattccagttactcaaagggacaaatacagaggaatagaaacatgatgtaatatgtcacactaaggaacagcgaactccagtgtctctggaatggagagaaaaaggttggatatgaaactgggtggatgggcattaatgatctcaagaagcatgtttatgtcatactcaggcaattatattcagcttgacatcaggaggaaaacaattttgagttggagatgaccttgtcacaatgtcatctcgcaaagatcagagaggtggtattactaaatctgttcaaagttgggtgcaggggcaaatgagaacaggaatcagattatgaaattagtgtaaaagctcataaaaagaaagatgcatctaaaatattcaagagagggataaaatgtaacagagtttggagtagaatcatcaagtttttatgattacttgcacagtgattggccatgtaaatgtgagaaaaatctaggaatccatattacagtcttgagaagccactagcttttctgaaaattaactggtaaaggagagatgtggtcaaagagcgagttactgttttgaacatattggaatagaggttgccgggagtggggggaaagtttaaaaggacatatccagaggtttagggttgagatgagaatttaagaatggtaagtgtatatctggtaaacttttgttgttcatgggaccatgtaaatggaatctgaagtattagaagtgaaaaggccaagaatattaccttagggaggaactgggggtaaaacgaattctctcatttaaagggttatttgaaaaagaaaagcccatgaagaaaactgaaaattgatatccagggagttatgaaagaaccataatagaatgatgtcaatttgttatattttttaacctttacaacaattacattgttcttgatgactaagatcattagtctaataactataattagttataattatgcaaaatgggagtgtaatttaatgtgctatttactgttctcaaaagatctcgttaatagtgtttatgaacagtgtttttctccatctttagaccatctctaaggtccttccagatacacacctaggatgcacatgaactcatgctatatttagaatcataggtttattcctaaaaatgcaagtgatgtacacagaacattatacataatagttgctgaaaaaatccatgaggcttttttagcctaacagtcattttatagatgagtaaatcaaagtccagaaatgataattcaaaaagtccaaatgtctgtgtagttagagttggggttgaaacagagatgcacttattttctatttcattatccatatttttttcacaatattgcactacctactcctaggcaattgggaagattttcaaattaacttgtcttcagtgataacaatagaaactattaaatgcaatgtgccttttaattatatcataaatttgcattatgccaaacacctatttttttgtttgtttgttttcacttaatgagctgttttagtactacatgacatagatgactcagatcttttcaaataatcttccagtctctgtagtcatccatgaatggcaggatcagcacttttttttaggaacttaagttataatatactactattgcaaaatacgtagtcagcattatgtttgtatttctcctatttatattctatatgtatctatatttctgagtgtattgaaaaaaatcaacattaggaagatacagggatgagggtgtaggagaaaatttgctaagctaatgctatgtacgatacttgtcagttggtcacctatatctccacattagtgccttagttaatgtgcagattcactgtgcacttttcattttatatatcattttcaagtgtattatattttgttctttgattatatggctctttatgtataaattagagataataatatctgaatacttaggattgctagaagcacctaataaaactgaaaattatctgtagttgtttcctaggcttcttctctgaattatgccttttatcacacataagagttgcatcagctgggcccggtggctcatgcctgtaatgccagcactttgggaagctgaggacaaacctgggagtcagaggcagaggttgcagtgagcagagattgcaccactgcactctagcctgggtgacaaaagcaagacactgtctcaaaaaaaaaaaaaaaaaagaaggtatttattgaacagatatgtatgagacactaggaatataatatgaaaaaagatatttacagataggcttaattaaaagattagaaatatatttaaaaaaatattaacaatggtcatactgtttactttgttgtacatgtctatatgtttgaatataaacccataatgtctttgtaattaagaaaaaaattattaaatttatatataaagaaaactgacttccaaattctctttcacctttcatttttatactccatcctttctatggcctttccctctcaaagactcatttatagtcttaagactttatgaatacaattttaagtgaaggattcgttagaaaagagaaggataacacatttatattattgctgcttgcaagtatttctattaatttatatttatgaattattcatagtattaaaactatgaaactacaaattcctgtttttaaggcattttttaaaaaataaaattaatcttctttattctataatactttaacatttctcatgactaaggtagtttttctctaaatctgcatttgcaaacctagctgcacaataaaattacttgaggagcttttaaaaatgtcttgccctgggccctacctttagatattttaagtcagccattctggggccagttcggaaatccatagttctaggcattcttctcagatttgcgtgcttaataattccattctttagaagtgatccacctttcacctatgaataatatcatcggtacctttaaacaaattgtaaggtgagtgtttctaaaaattgacataattgaagctaagctggtattagggaaacttacaaagtcatttctaccactctttctacataacttgcattgttctaaaaagtactcagcaaaattatgaagatattctagccccacagttatgaaagtcttataaagaaaaatccttcttttggccaggtgcgctggctcatgcctgtaatcgcagcactttgggaagctgaggcgggcagatcacttgtggtcgggagtttgagaccagcctggccaacatggcaaaatcctatctctactaaaaatacaaaaattagccaggcgtggcggcgggcccctgtaatcccagctactctggaggctgaggcaggagaatagcttgaacccaggaggtggatgttgcagtgagctgagattgtgccattgtactccagtctgggcgacaagagcaaaactctgtctcaaaaatataaataagtaaaaaaaaaaaaaaaaaaaaaaaaaaaaaagagttgcatcagtcccacaggacagtagctttgtttttaaatgatacaaattatttaaaatatttgtagtatgaggtactcttcatactttagaaagtacatgtattttgcagcacttttaaatacattgattattaaaatattattgttaactaataattattgatagagataaatgaacataatatataaatgcaaaccatgttagcaattataaatagtataatggaaaacatatttttcactcaactatttttaaagatattttaatgggagaaaatttttagtaaagatgcagttgaataagagtctaattttatttcattaagatttttttctaaaggcataatttggatttgaaaaaataaattgctgggtgcattggctcatgcctgtaatcccagcactttgggagactgaggcaggcagaccacgaggtcaggagttcaagaacagcctggccaatatggtgaaaccccattaaaaaattacaaaaattagccaggcgtggtggtgcacacctgtagtcccagctactggggaggctgaagcaggagaatcacttgaaactggtaggcagaggttgcagtgagccgagatcacgccactgcgctcctgcctgggtgacaaagtgacacttcatctcaaaaaaaaaagagaaaaagtaatagaaaaagaaaaaataaattaactgtaaaagtacatataaacatggagatatataaaatcataaaaggagggagatcaatcttctttgaacgtttctctgttatacaaaaaaaaaaaccctcactatattcaagtctatgtacttataaaaactaaaaacaaaatgtaggattcttatacctaagctgaaagcatttttataaactgcattttatatgtttgttcagaggaacttcataaatgtccaaatacttaaatgcaccatctaataaaaatatatgttacaaaaaagaatattgagtaggagtactctgaattctctgttgctttaaacacaagatatataattctatcaatctacaggatatacatgccacactataccatctttatcatcaaatgggtaaaaataccatctttacactgtttctgtgcttccaagcctctaagaagcttttgagtttttatgattttatgttatcattgagatggtagaataaagtaaggtgaatatttaaaagtaacataatatcctattttctgtttattctactcatcctcataataaaacagctaatacattctgaaatatttcaggttgtaaagaaagtttatttttcaccacgttgatgtaacttgtttgagaagtgtctatcaagaaaaaaataggaaaaatgaatgaaatttatattaaaaattctgtaactcagaataggaatatacaaaggctgtaagtcaaaatatgattgatacagtatcctttaatccttattatcctttgaaatagagatcctagataatacctgttaaaaatttgatgaatcaattattcatgtttttctaattactatttttgcctgtacatttgctatatttttcaccatagatgaactgtttctaatactcacatgaaataaaattatcccaaagaatctgtttttctaaatttttcagcttcttccaatttagttacgcttacaaataaattcatcttctgtccacaagtagcatatgctttcaaaggacaaaatttcttggctgtaaacattctccaagcaccagaaaatgtcttggctgtaaacgttctctaagcactgccatttatacaggcaagtgatttggaaatgaaaacttctatgatacagacaaatgatttggaaatgaaaatttctatgtgacagaatgtacatttcgaataaagtttttacagttttgatttgctttctatattcaaaagctatgctacacaatcagacatactgatctactcccagtgtcctcccttgttaatatttagacattctcagtggtctcatgtgttagagttatctaaaagcataggaaatttgaattttgttttgttgcattttttaatttcattcagtgtttaaattacgtgtcttggaggatggggaaagattagtcaacaggtacaaagttacaattaaatagaaataagttctggttttgtgttgcccagtagggtgatgatggttattattaagagtgaggtattgtattttacagaatagcttgaggagaggcttttgaatgttctcaccatagagaaattataaatgccttatacaacacacatatgtatcaaaacatcaaattgtatccctaaattatgtacaattacaatgcatcaattacaataagactcatatagtaatcacagtttaaatgaatgaaagaaaagtctcaaaaccataattagagcatcagactaggagatatgtttgtatggaaatgttaacttatttttcaggctatccaggtgtcagccccataattaaggaagggcagcaaaaggtttccctgtcctcaaattaaggctataagtaagtatttattgagcatccaactttagcctcgcagttaatttcttccttggaagtctctaagaatgtttaaacaaacaatttgctgggctcataaatcagaacatctacattatgtcaagtttttctttaaaatatttctaaattttatttataagtggcaaaaaccctgagatctctctatagtgaaatattatattcacagaataagtgattagattaaccacaaagctgttatgaacatttcctgaattgtgtttattttaagcctgtatcagatacattgatccacttaaaaatagaaccaatgcattttcttataagttcagcattaattatcatggtaaagacaatctactgattcatatcaaacatgagacaaaatgaaactgtttagacctatttttcttttatattcacaaaactacagttttgtgaaatccataacatttttggtttgtgattacacagtaattataagacagtgagacctattctgcaaccccacaggaaattgtactaatatattagaattatagacaacaaaaaagaaaaaagaaataaagggagagagaggaaagaagagaagaatggaggaagaaaactacaggtagaagtaattcagggcatgtaaaaaaaaaagtggaagaaaaaactcacttatattttttacctaggccatctggataaattaacattttgtatatgtatacattttatgaacaatagaaaatatttattacatataagtaaggcttattttggccaaatatcataaggaaattgaaaaataacagtgactgaaaacccagaagcaataaaggacagaaaaaaatataaactttgctacataaaatttaagaacagtttatacaacaaaaaaaaaatgaagaagtcaaagggcaaataatacattggggccatttttgtagtatccttaaaatataaaagttttaaaaatagtttaaaagattccaaaaatcttatagaataaatagcaaaacgtataaataaacaagtcatatgaatacaaatgatccttataccaatgtgtgtgtgaaaagctacactttaactataaaaacaaatttgattaaaaatgacatctgggatgtcttgagcatttattatgtaccaggccattaggcacgttgcagaaactgttttatatattcctcaatcttgtgagattggtactattcacatgcatgttttacagtggagaaaactatagtctagagagggtatttcataagcttgaccaaatttaaaatacaaggaatatgacatttaaaatacaaggcatctccttatatttgatttgttcaaaattccctcatgtagaaaagatagattagctatacttttacatattccttccacaaagtacagctaaaattcctggaacttacatataaatcaaacaaaagcatactgtaaaagggaagaaaagaaggcagactgcttagagatcttgggacccacggaatgacagaataggcagttccccttgttttctttttacctcatatatcacagactcaatgtatgctggagaagtcattcaaccagtaaacaccaatgtgtgcagactaaaacaaagaaacaaactaaaagcaagagaaactcattttgttttcctaaaacaccaagcttgaagggcaaaaaaactatgcatacaatgaccattctcctcaagccccacaccacagaaacaccttcaaccaccatttcctccctttgccagcgaaggcctgtctagcatacatcatccatgtccatgcatgtcctgctttaataaatgctccaaatgacccctcaacctatggaggtggtgtccaaagagacagcgtgacaagtgaattttttatccccgccaagcagtaacgagttctgctacctttgtcccgaagtgttatttcccaaaggtgggaggggcagtccagcctctgctcagggtcatccaccagacttagaaaaacaaaagcaaagaaaccttccatccaatgctggttttgaatgcttgtaaatgtctcttgatgaaatgtatttatacaaacaagtaaaaaagtaatccatatttagtacttattactattatttctatgttgttatgtacaaagcttttaaaattttgttttaaaaagcaatgattagctactttgattggtatattgtggggaatatatgtatatatatatgtatgtatgctcatgcaaatcacacaaatatatataaatatatttataagacttttggaagtctcaagactgtcatatatgactataactattttaatgatatataaacagatggttgtggttttgaataaattttcaagtgctcacatcatgcatggattttaaaaccaccttatatcaactatctctaatggaggaaaacatgagttgtactttgtaaaattattttggttattcaagtggctcatgtaataatgaagaagtggatgggaaagatgaatgtaatgttttttgcatgaactgtagtcatagataaaagcaatatgacaaacaatatattatacctgctatcatgtaattatcgctggtattttttcctatattttcccatactagaaagtaatttctgtaagctccaaattataccttcttcatttttttcctttctaatatatacagttaggacctaataaacacatttaatgaatatactaattcattttccttgataaaagtgccatttgaacttaatgaaaaacgacaacaaaattgttttacttctaaggacggcaccaagccaggagcctgggcacttgttgcaggttccccaagtacaaagtaaagcacctagtccaatgcctggtataaagtgggagtgcaggaagtgtgtagtgaagaagacagctctggatgctaaggagattgctcttggcattcttccatgccttgatcatccttaagggtaggccagattctagggattggcatctacctcaaataggaatcacctagaacattataaagtcaccagaatggggaaaggaaggctagaagggctcaaagaaccaaactaaccctcatcgttattctgctgaagaagagccatagtctgtctgtaagtatgtggtgtgtgggggaaagatctttagaatagacttcagaaaacccggaaccccttattagtcttggatctctgggccttcttcatctatacaatcagcagactgagttaagaaatctcagaggttcctttttgctttggcattctgtggaattgggatgattactattaatcagaatactaaccaccacttgtcagatactcattgcgtgtttgacatgatgctaagtacattattcttttatttaggcctcataacaaccctatgaggtagatactcttattgtcatttcatgttttacaaaaaggaaggccacacagaggtcgagggtgcagttaagactcaaatccagatctgtctaaatcaaaggcctgcttctttactattattatttgattagtatatttatatatttattttaaaaataatttattgaggtgaaatttacaaaataccaaactagtcattttaaagtgagtaattcagtgacaattaggatattcccaatgtgtaaaatcaccacctctatctaactacaaaacattttggtttctccagagtaaaaagctataccttaatcagtttcttcacattactccttacctcagaccctggtaaccgccaatgtgggttctgtctttatggatttaactattctggctattttatacaaatagaatcatataatatgcatggtttaaaaatagttgaatagggactgctcctccaggactcagaagacactcacaatactatgagttccccaactgtggaagcggggaaggaaaattctcctctcccgaacacacatccccactggggaaactgaaagtctgtttgctggagaagttttcaaacttatctggagccgagtcaatctagagagcccagcaaaatacaggggtagaagaagcagcaggaaatgtcctgggagcttgctgggtccctaagcagaccattcctgcctggcaccacagggctcctcctggagggcagccagaggagcagggacaaactccccagggagagggaagtctccagctgaacttagtaacaatttgaaccccacgagaagcttcctggccagaactcaggggagggtgcaaatctggtgtgcagactccataggcgaaggaagaaccaagcccttttctttcacagctgggaggtggctagcctgggtcaagatctcaaactgggcttacccaccacctggaaacagactcaactcgaggctgttagagaaggcatggtgggagttgaaaccagcccttcagtttgcatgggagctgggtgaggcctgtgactgctggctttcccctacttccctgacaacctgcatgactcagcacaggcagccagaatcctcccaggtacacaactccattgacctgggaacctcacccccatcccctacagcagctgcagcaagacccgcccaaggagagtttgagctcaaactcgcctagccctgccccaatctgtaggctttccctatccaccctggtagctgaagacaaatggcatataatcttgggagttctagggccccaccaccactggttcctccccatcatatcacagctggtgctccgtggaaagcacaacctcctggcaggaggccaaccagcacaaaaatagaacattaaaccaccaaagctaaggacctccacagagtcccttgcatcccccatcacctccactggaacaggcactggtatctacagctgagagactcatagacagttcacatcacagaactctgtgcagacaacccctagtaccagctccgagctgggtagacttgctgggcggccagatccagaagagagataataatcactgcagcttagctcacaggaagccacatccataggaaaagggggagagcactacatcaagggaacatcccatggaacaaaataacctgaacaacagccttgagccctagaccttccctctgacagcacctacccaaatgagaaggaaccagaaaacaaccagaaatatgataaaacaacgctctttcataccacccaccaaaatcacactagttcaccagcgatggatccaaaccaagaagaaatccctgatttacctgaaaaagaattcaagaggttagttattaagctaatcagggaggcaccagagaaaggcgaagcccaatgcaaggaaatccaaaatacggtacaagaagtgaaaggagaaatatttaaggaaatagatagcataaggaaaaatcaggaaacttcaggaaacaaaacttcaggaaacatcggacacactcaaagaaatgcagaatgcttcggaaagtctcagcaatagagttgaacaagtagaagaaagtcagagcttaaagacaaggtctttgaattaaccttattcaacaaagacaaagaaaaaagaataagaaaatatgaaaaaagcctccaagaagtcagggattatgttaaaccaccaaacataagaataatcagtgttcctgaggaagaagagaaatctaaaaatttggaaaacatatttaggggaataatcaaggaaaactttcccagccttgttagagacctagacatccaaatactagaagcacaaaggacacctgggaaattcatcacaaaaatctcttcacctagccactttgttatcagtttctctaatgttaacacaaaggaaagaatcttaagagctgtgagacaaaagcaccaggtaacctatacaggaaaacctttcagaataacaacagctttctcagcagaaaccctataagctggaagggatcagggttctatcttcagcctcctcaaacaaaacaaatatcggacaagaattttgtacccagcgaaactaagcattatatatgaagaaaagatacagtcattttcagacaaacaaatactgagagaattcaccattaccaagccaccattataagaactgccaaaaggagttctaaatcttgaaacaaatcctggaaacacatcaaaacagaacctctttaaagcataaatcacacaggacctataaaagtgaaatacaagttaaaaagcaaaaacaaaaaaacgaaaacaaggtacaaaggcaagaaatagcacaatgaatgcaaaggtacctcacatctcaatactaacattgtaaacatgtaaatggcttaaatgctccacttaaaagatacagaactgcagaatagagaagaactcaccaaccaatgctctgctaccttcaggagactcacctaacatatgaagagtcacataaacttatgtagcacctaaggttcttgcctagccacgccaaaaattggtgtggtggctgactgtgacaagtgatagagacacggaccgagagtgagaaaaagttgtaggttttattgagcagagtgaaagtacaaagcttccatagtgtggaaggggtcccaaatgggtagccagagttagattatataattgccttttaaactctttaaggtgggaaatacatgtggctggaagatgttaccagagtgagaaagaaaggcagtaaattattttgtgacatatcctagattttgaggaaaaccggaattgcaacttaggttttatttactttatgaccttgtagcggcatggcaaaggagagaggatcttacaggactttacaaaatatgtttacaaggaattggaattgggagtatagataaggtccgctggtcacagaaaaacaggcagttaacattccttttactttaatttcaggggaggcggagggagagaggacacagggaaacttacagcaaaattttcgctgtttatagctttcttcgggaagaaaacacatgcacaaatcctggtgttaggaatattttaagcatatatcttcaatattattcatccaggaccgaaggaagtcctgatgcaggaaatgagtaagtttcacagctttctgagcccctactggacccaggaagcctagctggcacctcctctcagttaaagtaaaggggtggaaaaagatattttatgcaaatggacagcaaaagtgagcagggatagctattcttataacaggaaaaacaaacttcaaagcaacagcaattaaaagagacaaagagggacattatataatggtaaaaggccttgttcaacagaaaaatatcacaatcctaaacacgtaagcacctaacgttggagctcccaaacttataaaacaattactaacagacctaagatatgagatagacagcaacacaataatagtgggggactgcaatactccactgacagcactagacaggtcataagacagaaagtcaacaaagaaacgatgggtgtattgtttatttatttttattttttgagacagtcttgctctgtcgcccaggctggagtgcagtgatgcgatcttggctcactgcaacctccatctcctgggttcaggtgattctcctgcctcagcctcccaagtagctgggattacaggtgtccaccaccatgctcagctgatttttgtatttttagtagagattgggttttatcatgttggccaggctggtctcaaaatcctgacctcatatgatccacctgcctcagcctcccaaagtactgggattgtaggcatgagccaccttgcctggcagaaacaatggatttgaactataccttggaacaaatagacttaacagatatatacagcacatttcatccccatttgcagaatacacattctattcaacagtgcatggaactttctacaagacagactatgtgataggccatataatagcctcaataaatttaagaaaatcaaaattacatcaagccctctctcagaccacagtggaataaaactggaaatcaactccaaaaggaactttcaaaaccatgcaattacatggaaattaaataacctgctcctgaatgagcattgggtcaaatacaaaatcaagatggaaattaaaaaattctttgaaccaaatgacaatattaacacaagctatcaaacttctggggggctgggcatggtggctcatgcctgtaatcccagcactttgggaggctgaagcgggcaggtcacctgagctagggagttcaagaccagcctgacaaacatggagaaaccccatctccactaaaaatacaaaattagctgggcatgttggtgcatgcctgtaatcccagctactcgggaggctgaggcaggagaatcacttgaatccagcagcaggcagaggttagagtgagccaagatcatgccattgcactccagcctgggcaacaagagcaaaactccatcacaaaaataaataaataagaacctctgggatacagcaaaggtggtgttaagaggaaaattcatagccctaaacacctacataaaaaacactgaaatagcacaaactgacattttaaggtcccacctcaacgaactagagaaacaagaacaaaccaaaatcaaacccagcagctgaaaggaaataaccaagatcagaacagaactaaatgaaattgaaacaaaaacaattacagaagataaatcaaacaaaaagctgcttctttgaaaagacaaacaaaattgatggatcattagcaaaattaacaaagaaaagaagttcagaaaatccaaataacctcattaagaaatgaaacaggagatattacaactgacaccactgaattacaaaagaatattctaggctactacaaacacatttatgcacataaactagaaaacctagaagagatggataaattcctggaaaaatacaaccctcctagcttagttcaggaggaattaggtaccctaaacagatcaataacaaacagtgagattgaaatggtaatttaaaaattaccaacaaaaattaaatccaggaccaaacagattcacagcagaattctaccagacattccaagaagaattggtaccaatccttttgactccatcccacaagacagagaaagagggaatcctccctaatttattctatgaagccggcatcaccctaataccaaaaccaggaaaggacataaccaaaaaagaaaactacagactgatatccttgatgaacatagatgctaaaatccttaacaaaatactagctaaccgaatccaagaacatatcaaaaagataatccaccataatcaagtgggtttcatactagagatgtagggatgatttaacatacacaagtcaataaatgtgaaacaccacaaaaacagaattaaaaacaaaaatcacatgatcatctcaataaatgcagaaaaagcattcaacaaaatccagaatcgctttatgattaaaagtctcagcaaaatcagcatacaagggacatacctcaatgtaaaaaaagtcatctatggcaaacccacagccaacataattctgaatggggaaaagttgaaagcattccctctgagaactggaacaagacaaggaggcacactgtcaccactcctcttcaacatagtactggaagtcctagccagagcaattagataagagaaagaaataaagggcatccaaattggtaaagaggaagtcaaactatgcctgttttctgatgatatcatcatttatgtaaaaaaccctaaagactccttcagaaagctcctagaactgataaaagaattcagcaaagtttctggatacaagattaatgtacacaaatcagtaactcttctatacaccaatagtgaccaagcagagaatcaaatcaagaacttaaccccttttacaatagctgaaaaaaaaaattaggaatacacctaactaaggaggcaaaagacttctacaaagaaaactacaaaacactgctgaaagaaatcatagacaacacagacaaatggaaacacatctcatgcttatctattgtgaaacaatacattgttccacaatgtgaaacaatacattgttccacaatgtgaaacaatacattgttccacaatgtgaaacaacattgtgaaaatggccatgcggccaaaagcaatctacaaattcaattcaatccccatcaaaacaccaccatcattttttacagaattaggaaaaaaacttccaaaatttatgtggaaccacaaaagagcctgcatacccaaagcaaaactaagcaaaaagaacaaatctggaggaatcacactacctgacttcaaactagaatataaggccatactcaccaaaatagcattgtacttgtataaaaataggcacataggtcaatggtacaaaatagagaacccagaaataaacccaaatacttacagccaactgatcttcaacaaagcaaacaaaaacataaaggggggaaaggacaccagtttcatcaaatggtgctgggataattggctagccacatggaggagaatgaaactagatcctcatctctctcaccttatacaaaaatcaactcaacatggatcaaaggcttaaatttaagacctgaaactataaaaattctagaaggtaacataaaaacccttctagacattgacttaggcaagggtttcatgaccaagaacccaaaagcaaatgaaataaaaacaaagataaacagttgggacttaattaaactaaagagcttttgcatggcaagaggcacggtcagcagagtaaatagacaacccacagagtgggagaaaaccttcacaatgtacacatctgacaaaggactaatatccagaatctacaatgaactcaaacaaatcagtaagaaaaaaacaaacaatctcatcaaaaagtgggctaaggacatgaatagacaattctcaaaagaagatatacaaattaccaaaaaacatgaaaaaatgttcaacataactaatgatcagggaaatgcaaatcaaaaccacaatacgataccactttactcctccaagaacagccataataaaaaaaaatgaaaaaccagtagatgttggcgtgtatgcagtgatcagggaacacttctactctgctggtgggaatgtaaactagtacagctgctatgggaaactgtgtggagattccttgaagaactaaaagtagaactaccatttgatccagcaatcccactactgggtatctacccagaggaaaagaagtcattattcaaaaaaaaaaaaaaaaacttgtacatgcatgtttatagcagcacaacttgcaattccaaaatcatggaactgagaggtgaaggcagcggggcttctgggtcaggtgaggacttggagaacttttctgtctagctaaaggattgtaaatgcaccaatcagcgctctgtgtctagctaaatgcttgtaaacgcaccaatcagcactctgtcaaaacggaccaatcagcactctgtaaaatggaccaatcagctctctgtaaaatggaccaatcagcaggatgtgggtggggccaaataagggaataaaagctggccacctgagccagcagcagcaacccacccaggtccccttccatcctgtggaagctgtgttctttcactcttcgcaataaatcttgctgctgctcactctgggtccgtactacctttatgagctgtaacactcactgtgaaggtctgtggcttcactcctgaagtcagcaagaccacgaacccactagaaggaagaaactcaggacacatctgaacatctgaaggaacaaactccagacacaccatctttaagaactgtaacactcactgtgagggtctgtggcttcattcttgaagtcagtgagacaaaaaacccaccagaggaaccaattccagacacagaaccaacctaaatgaccatcaatcaatgaatggatggatgaagaaactcatatatatatatatatatatatatatgtagatgagatacatatgatggaatactactcatccataaaaaggaatcaattaagggcgtttgcatccacctggatgaattggaaactattattctaagtgaagtaactcaggaatggaaaactaaacattgtatgttctcactgatacgtgggagctaagctatgagaatgcaaaggcataagaatgttacagtggactttggggacttgtggggaaaggatgggaggagaggcgagtgataaaagactacagatagggtgcagtgcatactgcttaggtgatgggtgccccaaaatctcacaagtcaccactaaagaacttatgtaatcaaatatcacctttaccccaataacttatggaaaaattttaaaaaatagaaacagataaataatggaataagtaaagccaggtttgcataatttttaagctatattgttaagtacttttgacacaatagacctagggaaagagccaaagtcttctggaatatgcagcatttctccaatacttactaagcaaagcaaagaatttttcttcagatgtatttattatttattagaaaggagtatttcaagttctcattgtgtgtttccagtttaagattttcacgtctcatcatttttgtgtgttttatttttctcttgtcttttgaatctgctttgtggaaatgttctcaaaattttcttctgcattactgatatggttttctacaaaataaactctgagttcaattaaaatgttaattttgttactgcactttaaggttataagcatctaatgttattgtcttttaatattggcacatttaccctatgtggttttctgctatgattttatgaaagccatattatttttcacctaccagatgctaaacacttttctaaggtatttttcattttttgtatttacaaaggttcaaataattcaaagaaaatgcattttttactaccatatctatatgcagcagataagaggatggaacttagttttaacatttgcttgcttcattaacataattaataacaattttatttcttgctttagatgtaatattaaattatttatgttcttatgtaaattattcttagaaatatatattttatccaaattgatgtaagaatttctatctgttcattaaaaaatggactttgtgagtcttgctctaaaagtagttctcactatagtgtattgtttaagctacaaaggcaaagcacaactgagaatataaaatttctgattaatacagaaccatactaagaaccaaggtgataatgaagttgaatttaagaattatgtagatatactattactatcaaccgaaagtagtaggatagttacacaatttagttccaaaatgtgtgcaagttcaactagaggtattacaaaaagaatgtcaatacttctcatgtaatcttgactactttatataagagaaacaataatgcaggatttcactttcacatgcctgcagagggtgattaagaattaaactgttaagaaaaaaaaagcgaagggggcagggggaattggtggtaaaaatgaaactgccaattgcattcaaactaattaaaaacaaaatacacaaaaatgacgaaacaaatcagtctgaaggatagatcacacaagtttttcttttttttatggtccaatgtatatactaagtgaataactttggcttttgttatcctaacatagctattgattttattttggcttatttccttgacattttatttttatttatttattaatttattttgttttattttactgtaagttctggaatacatgtacagaatgtgcacatttgttacataggtatatgtgtgccatggtggtttgctgcacctaactacccattatctaggttttaagccccacatgcattagctatttgtcctgatgctctccctcccctccctccaccacaggccccgatgtgtgatgttcccctccttgtgtccatgtgttctcatggttgaaattccacctgtgagtgagaacatgcagtgtttggttttctgctcctgtgttaatttgctgagaatgatggtttccagcttcacccatgtttctgcaaaggacatgatctttttatggctgcataatattccatggtgtatatgtaccacatgttctttatccagtctatcactggataaaccaatcattttggttggttccaagtctttgctattgcaaacagttctgcaataaatatacatgtgcatgtgtctttgtggtagaatgatttacatttctttgagtatatacctagtaatgggattgctaggtgaattggtatttctggttctaaatctttgaggaattgccacactgtcttccacaatggttgaattaatttatattcccaccaacagtgtaaaaacattcccatttctcaacagcctcctcagcatctattttttcttgactttttaatgattgccattctgactagaatgagatggtatctcattgtggttttgatttgcatttctataatgactaatgatgttgagatttttttcatatgtttcttggccacataaatgtcttcttttgagaagtgtctgttcatattcttagcctactttttgatggggttgtttgattctttcttataaaaaatttgtttaagtaccttgtagattctggatattagaccttcatcagatgggtagattgcaaacattttctcccattctgtagtttgcgtgttcactctgatgatggttttttattttttttctgtgcagaagctctttaattagattccatttgtctagtttgctattgttgaaatagcttttggcatttttgtcatgaaatatgtgcccatattctgaatgttctgtatgcccatattctgtatgttctgaatggtactgcatagattttcttctaggatttttatagtttgaggttttacatttatgtctttaatccaccttgagttaatttttgtataaggtgtaaggaaggggtccagtttctgttttctgcatatggcttgccagttttcccagtaccatttattaaataggaaatcctttccccattgcatgtttttgtcagctttgtcaaagatcagatgtttatagatgtatggtattatttctgaggtctctgttctggtccattggcctatgtatctgttttggtaccagtaccatgctgtttggttactgtagccttgtagtatagtttgaagtcaagtagtatgatgcctccagctttgttcttttgcttagggttgtcttttttggttctgtatgaaatttaaagcaggtttttctaattctgtgcagaatatcaatggtagtttgataggaattgcattgaatctataaattactttgggcagcatgaccattttcatgttactgattcttcctttccatgagaatgaaatgtttttccatttgtttgtgtcgtatcttgtttccttgagaagtggcttgtagttctccttgaagaggtccttcacatcccttgtaagctgtattcctacatatttttttctctctgtagcaattgtgaatgggaattcattcatgatttggctctttgcttgtcttttgttggtgtataggaatgcttatgatttttgcacattggttttgtatcctgagaggttgctgaaattgcttacagcttaaggagttttggggctgacacgatggggttttctaaatatagaatcttgtcatctacaaacagagacagttagactttctctcttcctatttgaatatgctttatttctttctctttcctgattgccctggccagaacttccaatactaggttgaataggactggtaagaaggagcatccttgtcttgtgttagttttcagagggaatgcttccagcttttgcccattcagtatgatgttggttgtgtgtttgtcataaatagctcttattattttgagatatgttccatcaattcctagtatattgagagtttctaacatgaaggaatgttgaattttatcaaaagccttttctgcatctattgagataatgatgtgctttttgtcattggttctgtttatgagattattgggaaacccgcccctgataattcaacattatttcacgtaagttcttttctatttccctaagtgtcagcctgtctgagaaataatggaaaagagtacaaaagagagaaattttaaagctgggtatctgggggagacatcatatgtcagcaggttccatgatgccccccaagccacaaaatcagcaagtttttattagtgattttcaaaaggggagagagtgtacaaatagggtgtgggtcatagagatcacatgcttcacaaagtagtaaaatattacaaggcaaatagaggcagggcgagatcacaggaccagggcgaaattaaaattgctaatgaagtttcgtgcacgcattgtcattgataacatcttatcaggagacagggtttgagagcggacaactggtctgaccaaaatttattaggcaggaatttcctcatcctaatagtcctgggagcgctatgggagaccagggcttatttcatcgcttatctacaaccataaaagacagacattcccagagtggccatttcagagacctacccctaggaacgcattctctttctcagggctgtttctcgctgagaaaaagaattcagcgatatttctcctatttgcttttgaaagaagagaaatatggctctgttccacccggctctcaggcagccagacctaatggttatctcccttgttccctgaacgtcgctgttatcatgttcttttttcaaggttcccagatttcatgttgttaaaacaatctgtgcagttaacgcagtcatcacaggttcctgaggtgacatacatcctcagtttaagaagatgatggggttaagagattaaagtaaagacaggcgtaggaaatcacaagaatattgattggggaagtgatacatgtccatgaaatcctcaaaatttatgttcagagattgcagtaaagacaggcataagaaattataaaagtattaacttggggaactaataaatgtccatgaaatcttcacaatttatgttctgctgccatggcttcagtgggtccctccattcagtgtccctgacttcccgcaacatgagatggattacatttattgatttgcatatgttgaaccagccttgcatcccaaggatgaagctgactggttcatagtggataagctttttgatgtgctgctggatttggtttgccagtattttattgaggatttttgcatcgatattcattagggatattggcctgaaattttatttttttgttgtttctctgacaggttttggtatcaggatgaagctgctctcataaaatgagttaggggagtcccttcttttcaattgttttgaatagtttcagaaggaatggtatcagctcctctttgtatttctggtagaattcagctgagaattcatctggtcctgggctttttttgatttgtaggctgttaattactgcctcaatttcagaaccagttttgcatacctatttgtgactaatgagtaaaataatctctagctagaaaaatcattgaccagcaattaatgtaatctgaaactgattttgctgtcagtcagatgtattttatgactatgtaaaattatagttttcatgaagagacatgaagaaaatatcattgtttaatgattctagaatcactggccatgcagtttagtaaatacagaatatcagcattaagagtagaaagaaaatggataatgttgtggataatcatcttatgactgattagagcacagaatttcattgacatggctctaccttttactactgtaaggaaaacgctttactaaaggacagacattataactacacaacatatttaataaggctcattgatattattaatgtaggaatacctaaatgtcaaaagaataaagttgtttcaatcttattggaatgattggaaacattgcaataaaacaaaatataagacatttttcctcttcgcaaattccattccaagcctttaataaagagaaactcaattacaaaaaatatgagtatgatagtctagggcagctttataggctttatttagacaacattatttgttggcagcctcgacggaggtagtaattactagtgagaaaagcaaacacacaacaaagaaagatggatccatctgaagcatgaaagtaaagctattgtttcttttatgaaaggacagttaaaattctgctgtgttaaattctgccatgttaaaattctgccatgttaaaaaattctgccatggtaaaattcaaatgaatgaccttttgcaatatattggaaacaaaaatacattaataaatatagaaaactgggatgagtttgattttctaattgtagaaaaaaacgaaaacaaaaactttagacctaggctataatgtgaactcccaaagttttacaagaattaaaatcttccagggtgtggtctctaaacacattagaatgaatgtgaaaaattaacaaaacatagtagctctaatacaaactagaaaacctagaagaaataaactcccagaaacatataatctcccaatattaaaccaggaagaaattgaatcccagaacagaccaataatgagttctgaaattgaatctgtaataaaaaagtgtacaaactacaagaagcccaggaccagagagattcacagacaaattctaccaaatgtataaagaagagctggtaccattcctgtggatattgtcacaaacaattaaggaggaaggactcctctgtatctcattctacaatgaaagcattattctaataataagcagagacagagacacaacaaaaaaagaagacttcaggcctctttgatgaaaattgatgcaaaaattatcaacataatactagcaaaccaaatccagcagcacatcaaaaagctcatggataaatactgttaaaatgaacatactgcccaaagcaatttacagactcagtgctattccaatcaaactaccaaggttattcttcacagaattagaaaaaaaaactattttaaaattcatatggtaccaaaacagggcctgaatagccaaagtaatcttgagaaaaaagaaaaaagctggaggaattacattatctgacttcaaactacagtacaaggctacagaaaccgaaacataatggtactggtataaaaacagacacatagaccaatggaaccaaagagcccccaaataaagccacacatacctacattcatctgatcttcaacaactgtgacaagaaccaagaacaagcaatgaggaaaggaatcaatattcaataaatgatactgggataactggctacctatatgcaaaagacaggaattagaccctttccttacactgcatacaaaaatcaactcaagatggactagaggcttaaatgtaaaaccccatgtataaaaactcaggaagataacctagaaaatatcattctggacataggctctggcaaagatttcatgacaaagacaccaaaagcaattccaacaaaaacacaaattgacaagtgggacctaactaaactaaggagcttttgcacagcaagagaaactaccaatagagtaaacagacaacctgtagaatgggagaaaatatttgcaaaccatgcatctgacaaagatctagtatccagaatatataaggaacttaaacaaactaacaagcaaaaaccaaacatccccatagaaaagaaggcaaaggtcatgaacagacacttttctaaagaagacatacacatagccaacaagcatataaacaaatgctccacagctctaatcattaaagaactgcaaattaaaactaccatgaggtaccatctgacaccagtcagaatggctgttattaaaaagaaaaaaaataacagatgctggggaggttgtggtgataagggaacacttatatactgctggtaggaatttaaattagttcagtcattgtggaaagcagtttggtgatttctcaaagaacttagaagtaccatttgaccccgaaatccaattattgggtgtatatccaaaggaatatcaatcattctaccataaagacacattcacatgtgtgtttgtcacattattcacaatagcaaagacatttgaatcaacttaaattcccatcaatcttagactgaataaagaaaatgtggtacatatacaccatggaatactacgcaaccataaaaaaagaatgagataatgtcctctgcagcaatatggatagagccagaggtcattatcctaagtgaactaatgcaggaacagaaaaccaaatatcacatattttcattttttaagtgggagctaaacattgagtacacatggacacagggaaacaacagagagctaatgttattcataagaacattctttattttaaatacatatatcagaaataaataaagacgaaatctgagacctgacttcccacctcgagaatctgggaaaacagaaagtcaacgtgtaggaagtagtaggaagaaaataataaagagtaattagaaacaaatgaaatacaaaataaagtatgatagaacaaataaagaaaaacaactgttgatgattttttgaaatgattagtaagattgataaacacacaaaaagactcacaatgaaaaatgtgaacaaatatgtaccaccaataacaaaaatatgaacaaagcaaaatgagacaaactgcaagaaaagaatgaattgcaacatactgtgtagacatagataatataaagaacaacttgaaatcaaaaaatgtatcatttttgtgcaatggaaaaaatttctcaaaaaatacaacttaccaatattgacgcacacacaaaatatgaaatctgaagtgtgcaatattgttaaagaatttaaagctatcaataagtaataaatttttctaaaaatatttaaaaataagtacttattttgactttaaattcaagggtagttttgttacatagataaacttgtgtcatggagattttgttgtatagattatttaatcacccaggtattaagcctagtacccattagttatttttcctattctctctctccttccactctccacactccaaaaggtcccaatgtgtgctgttcccttctatgtgtctatgcattctcgttatttagtttccacttatactttcctgtcctgcattagtgatgacagccacgggccatccagattggctgctgccatcacgctggttacagtggggaggggcaagtggtggtggcaggagcagctgtgtgagtagcagtggcggtggtgggacccctgcgccccacatctcctgtgtcctgcatccccgaggtagcctactgcactgctcctaccctcacccagccgggcaggccctactcccaggcccagagcctccactactccgaatccttacccatcagtgctctcgtgtacagctgcttggggattggggagggaggaggtgggcagtccctggagcctacccctgggagcctcccagaaactgctatgatgggggccaccgccatgaggccaggccaagtcactcgctggcagaggagcagtgcagtcaggcacaggttgggggatgaagaagcagagctctacccagggtggcactgtgctccacagagccagtgggagctgagaacaagcaaggagccccacctcttcccagttggtggagcaggagcgccccagacacaactgtagcctccaaagctgcagttgccacctgggcacccctgtgttcttggcagccagaagcaggcaggagccccaccatcccaggcacagctgcagccacccaagccgcagctgtggacccaggcatccctgcactctcaggggcctggaaaggcccccctttcaccctcaggcttggaagtgtctgtttctgctgcctggctgctccccacttctggtacaggctcggatcctggagcaaagatgggactaagtctgtgggccatcacagcctggccagttgtgtgtatgcttggggcactcctgacatgtcagccccctaccaccttggccacctccagactttgggcaccaaggagcatggaagggaggccaaggaggggctgagggcagcttgacactggcccgaaggcaccccttggcacaaacagcctgggtgccatgaagggtggcaggagacaggctcctgggtggaagagggtgggtctctggtgaagccccagcttcaagctggggaaggcctgaagcctgggggctgtgctgctggtcccatagactggagtgggaatgtgtgatgcttttccctgggcccacccatggccacccatggaccagtcagcacccacttcctttcctctgaggcccataaaaatcccagactcagccagactcaaagagaggatgggaagtggatggggagacaacaggttgaccaactgcagagagaaagtgaggaggctgcaagatgaccatttgcagagaggagctaccttgtccactgaaagctgaaaaagatgataggttgaccagctgtgaagaggagctaccctctgtgctctctgagagctgagcacttgttgggatgacctgcctagaagagaggagctacactctgtgctgagagctgaacactcattgaaacaccctggctatggagagaagctgcccactacaggtctcctctgagctgttctattggtcaataacatgcctctttgtcttcctcaccctccacttttctgtgtacctcattctgcctggacacaggacaagaacttgtgacccactgaatggtgaagctaaaagagctgtaacataaacagggctgaaacatgtcccttgctcaccacattgagtgtgaagaggacagaagagcaataggcctttggggagcccagacctgagagctccctgagccagggctgttactctctctttcaggctctgcagtttctggtgtctccaagcttccaggtgctaccacattccccggtgctagccggggcagctgcctgcagcacgcctgattgagctgcagcctcacagagagcaggagcccatgctggcacctggagctgcctgtgccatgtcagtagccagcgggtctgactgtacacagtggctggactccatgctcactcacacacccctcaccactcaacgcctgacttgctgtctcccttggaggcataggatccaggccagtaatgcgagctgaacttagcctgccaggctgagtgggtggaacaagcccagcaggcccaagcaaaacttgagcaaaggtgccacaagccagagattttcagccagaaaagtgactccccaaacatccagtagcattagtttgctaaggaaaatggcctccagctccatacatgtccctgcaagggacatgatcacattcttttttatggctgcatagtagtccatggtgtgtgtgtgtgtgtgtgtgtgtgtgtgtgtgtgtgtgtgtgtgtgtgtgtgtacatgttctttatccagcatatcattgatggacatttaggttgattccatgactttgctactgtgaatagcgtcgcagtgaacatatgcgtgaatgtgtctttttaatagaataatttccattcctggcagggtttggtggctcacgcctgtaaacccagcactttgggaggccgaggcaggcggatcacgaggtcaggagatcgagaccatcctggctaacacggtgaaaccccgtctctactaaaaatagaaaaaattagctggatgtggtggcgggtgcttgtagtcccagctactcgggaggctgaggcaggagaatggcatgaacccaggaggcagagcttgtagtgagccgagatagtgccactgcactccagcctgggcaaaagagcaagactccatctcaaaaaaaaaaaaaaaaaaaagaaagaataatttctattcctttgaggatatgcccagtaatgggattgctgggtcaaatgttatttctgtctttaagtcattgaggaattgccacactgtcttccacaatggttgaactaatttacactctcactaacagtatatgtattcccttttctacacgatctcgccagcatttgttattttttgactgtttaatagtagccattctgactgaggtgagatggtgtctcattgtggttttgatttgcatttctctaatgatcagtgatgttgagctttttatcatatgattgttcaccacatgcatgtctttttttgaaaagtgtctgttcatgtccttttaatgtttttttttccttgtaaatttaagttccttatagaagctggataccagacctttgttggatggatagtttgcaaagatattctcccattttttaggttgtctgtttactctgttgatagtttcttttgctgtggagaagctcttttgtttgtttagattttgtttgtcgatttttacttttgttgcaattgcttttggcttcttcatcataatatctttgcccctgactatgtcctgaatggtattgcttcagttgtcttccagggtttttatagtttggggttttacatttaagtctttaattcatcttgagttaatttttgtatatgttgtaagtcaggggtccactttcagtcttcggcatatggttagccagttatcccagcacaagttattgaacagggaatgctttctccattgcttgtttttgtcaggtttgtcaaagatcagatagttgtaggtttgcagtcttatttctgggttctctattctgttcccttggtctatgtttctgtttttgtaccagggccatgctgtttcggttactgtggccttgtattgggttggtgcaaaagtaattgctgtttttccattacttttaatgacaaaaactgcaactgtgcaccaacgtatagtttgaagtcgatggcatgatgcctccagctttgtactttgtgcttaggattgtgttggcaatttgggctctttttttggttcaatatgaattttaaaatagttttctctagttctgtgaagaatgtcaatggtagtttaataggatagcattgaatctataagttgctttgagcagtatggccattttaattcaagtaacaactgatatttctttcccaaatctttttctgaggctgtatttatcataacataataaataagtaaccaagggcattacaagaaagaaaaattaccaattgatctctcttgcgcaattagatacatatatatcctaaacagaagatgagtggagtttatttcagaaatgtgatgctgatttaatatttgagaagcaattattataatgtatccaccacattaatgaaaaagtgagaaatattatataatcattttaatgtatatggaaaaatgataaaatttaacaaccattcatgatacagactccttgcaaaccaagaataaaatgaatcttttttaattttgtaaagaaataatacaaaacctatagtaaatatcacattaaatgataaaaatatttaaatatttctcccacagataagcaaataattacatttgcccattgttactgtttcattcaacaccatcctggtggtccaagacagtgtaataagacaagataaaatttaaggtataaaaactggaaagaaagaactaaaacagccattatttgccaattacagaatgatataattaaaaaaatacaggaaaatttatgaatttagcaatgtttgtgggtaaacctcaagaaacaaatcagttttatttctatatctaaaaaaactagaaaattaatttgcattatttaaagcattattttcactgttacaaagaaacattaaatacttcagtacagctgataaaagttttgcaataagcttgaaaccacgaaaacattttgagaaaatatttaaaagcctataaaaggatgaacatgttatgtatatgtttttaatgctatacaaaatatcagatgtttctaagctgatctatattttcagtgatatccccatttaaataccagccactttgtggggaaacagatgattgacaagcacatctaaaatttacataaaatagcaaatgaccaagaatatccacagctggcacaaagaccaaaacaagaatttacactattagagatcaagacaaaatagagcctagaaatagaactcagaatgtacatccacttgacacatgataaaagctatattagaattccacaaggaaaatagaaacgttttattaaatctatctagattaattagatatcctttttaaaaatgtatcttaatccccattttataccatatccagaacatagatatttaacacattaaaagataaacctataaagctataaaagaaaacgaaggtgaacatcttcatgactctgatgtaggcaaagttttgtcaaagacaaaggactaataatgtaagtataaaaatgatacgctgtactacagtgagatgtgtattcatcaaagtacattagaggaatgtaatggaaaatcagaatatgagaagagatatttacaatacacattctccaagaaatgcatatactcagaatatatacaaagggattttaagagcagttatgaaatgacaggctgtctccaaagaaaaattggcaaaattataaagaagtaattcacaagagattattcaaatggacaataaatgcataaaaatgtgcccttaactctcctagtaatgaggcacaaaagcaaataagagataatgctacattcccagcagaatcactaaaataatgaagagattgaaagacaaggtcaagacacattgtagaacaaaggcagctctcatacacagctggtgagtaaactgctataatcactttgaaaagctatttggtacaattactaaggttgaactcaggcataattatggtaaataattttagttctctgtgtatacctaaaacaaatgtgtacatatgttcatcaaacatatgagggagggagggatggagggaggaagagagagagaggcagggtggggggggggtagagagagaaacagaaagagagagagagagagagagccataatgttcaaagtagtactgcacgtagtagtttaaaatcagaaatacccaaatgcccttgaacagtagaatgtgtaaatatgttgcagtatttttaaaaacgaaatgctacatagaaatgatagcaaaatataatggaatctcataaacataaatgaagagcaaatgaagccagttacaaacactgtatgattcaatttagataaaagttcaaaagcaggcaaaacatatctatcgttttctttctttctttcttttttttttttttttgagacggagtctcgctctgttgcccaggctggagtgcagtggcacgatctgggctcactgcaagctccgcctcctgggttcacaccattctcctgcctcagcctcctgagtagctgggactacaggggttggccaccacgcctggctaattttttgtatttttagtagagacggggtttcaccgtgttagccaggatggtctcgatctcctgacctcgtgatccactcgcctgggcctcccaaagtgctgggattacaagcgtgagccaccgcgcctggcctacatatctatagttttcaagtcacaatggtagtgtggtgtctctgcaatccaaggtggtgggagtttaggaaggttatgattggtaagagcacaagtagactttgaggatgtcagaaatgttgggtttcttgatctgggttctggctacacagtttcttattttgtaaaattcattgagctttacatatacagtatgcatacttgtttgcaggtgggttgtgctgaatagatagtttaaaatgtttgcatagaaggactagcattaaacggattaaaatagtaagaatgtgtatctctgtaagagagagtccatcatcctctcacctgtttcagagattgtatgactaatagaattagtattcaatgagatgttaggcagtgtctaaaaataagctatataatcaaatatcttgtacttggtgaactaccattaatattctcattttaaaaacaatgagaaacttcagagaaagcacagctattttatattgtaaacttagaatttcacaaaactaatagtcagtgggatattagctccattatattctcttcaaatgcctagaagaattcaataatttttcaaaaaaaaactttgagaaatactttacttcctaaaatattctgaaatgttatcaactaagaaataagctatagattaccatagcagttcacaaactcctcctgccctagaggctccaattgaaagccaaagtaagccctagcttttataactaattgatgatattcctggttctcaaactcaggtataaagaagctatgattttctatacatcaattcagtctttgaatcactattcatttgcatcatttaaaaactggacctcggctccagcctagttttcattctctcctgtaaggccctgatttgccccctcttgctcactctgctctagccacagcggccttctagtagtttttgaaacaaaccaggcacccttctttcctacctggggcatttgtatgtgctgctctcattgcatgagtcttcctcacattttcatatgtcctgcattctcacctccttcattgtcttgaagcaaatgtcaccttatcaataaggccttacagtataaaattgcaagcggtcaaccttctttatagccacttttcttttcttttcttttcttttcttttttgagatggagtcttgctctgtcgccagcctggagtatagtggcgcaaactcagctcactgaaacctccggctcccagcttcaagtgattctcctgactcagcctcccgagtagctgggactacaggtgcgcaccaccatgcccagctaatttttgtatttttagtagagacgaggtttcaccatgttagccaggatggtcttgatttcttgacctcgtgatccacccacctcagcctcccaaagtgctgggattacaggcgcgagccactgcacctggcctatgttttttttttttttaatttgaaaattcagctattttctctctctctctctctctctctctttttttattatactttaagttctgggatatatgtgcagaacgtgcaggtttgttacataggtatacacgtggtggtttcctgcacccgtcaatccatcatctacattaggtgtttctcctaatgctatccctccccttgccccccatcccccaacaagttctggtgtgtgatgttcccctccttatgcccatatattctccttgttcgactcccacttatgaatgagaacatgcagtgtttggtcttctattcctgtgttaatttgctaagaatgatggtttccagcttcatccatgtccctgcaaaggacatgaactcattcttttttatagctgcttatactccacggtgtatttgtgccacattttctttatccagtctaacattgatggacaattgggttggttccaagtctctgctattgtaaacagtgctgcaataaacatacgtgtgcatgtgtctttataggagaatgatttataatcctttgggtatatacccagtaatgggatggctggtcaaatggtatttctagttctagatccttgaggaatcgccacactatcttccacaatggttgaactaatttgcactcccacgaacagtgtaaaagcgttcctgtacctccacatcctccccagtatctgttgtttcctgatttttaatgattgtcattctaactggcatgagatggtatctcattgtagttttgatttgcatttctctaatgatcagtgataatgagcttttttttcatatgtttgttggccacataaatgtcttcttttgaaaagtgtctgttcatgttctttgctcactttttgatggggttgttggttttttcttgtaaatttgtttaagttctttgtagattgtggatattagccctttgacagatggatagatggcaaaatttttctcccattctgtagattgcctgttcactctgatgatagtctcttttgctgtgcagaaactctttagtttaattagatcccatttgtcaattttggcttttgttgccatttcttttgttattttagtcatgaagtctgtgcccatgcctatgtcctgaatggtattacctagaagcatcaggctacctgacttcaaactatactacaagcctacagtaaccaaaaaagcatggtactggtatcaaagcagatatatagaccaatggaacagaacagagacctcagaaataacgccacacatctacaaccatctgatctctgacaaacctgacaaaagcaagcaatggtgaaggaattccctgtttaataaatggtgctgggaaaactggctagccatatgcaggaaattgaaactggaccctttccttacaccttatagaaaaattaactcaagatagattaagtatttacacctaagacctaaaaccatgaaaactctatagccactttctgctccatgtttctccctagcatgtctcacaatcttgcatagcacatttatcattagatatgtataatgatatctatatctacctatatctataaatatctataatgatatatttacatatatctatttataaatatataattatataaattatataattatagatctatagtgacatataattatagatagatgtagatatagatatcactatccatatataatgtgtgtaccaaccacattaatgaaaaaatgagaaatattatacaatcattttaatttacatgggagaaaattataaaatttaacagccattcatgagacagactctttgcaaaccaagaataaaatgaaactttttaattttggaaagaaataatacaaaacctatagtaaatatcatattaaatgataaaatattttctcccacaaataataaaataactacaactgcccactgttactatttcatttaaagctatgttggtggttgaagacaaataatatatatatatatatatatatatacacaattttattacatatgattttattatatataattttattttatatataagtttatttttatatatatttatatatgtgtgtgtatatatatatatatatatatatatatatttgtgtgaccttagaacaagaactcactcatcaccaaagcccaagcaatttatgaggtatgcaccccatgatacatatatagctgaagccccgtataaaatatatatatgtctccctcccttttcccctacggctacattcttggcacccagagcagtgcctggcacagaggagatgctagatatacacttgttgaatgagtgaatgggagtattatcagtgcatctcaatgggctccatagcaaaccctcagtctttgaatttcaaagttcattttgagatacccatcactcaagtctacatggccctcagacagtattacaacttgcatgcaaactgtcacagaaaacttttgttatttacttattgtcctgtctatccagattctctatgagagtatctctctccccactcttgccactgccttgattatgctaatcaaaagaaagttgtgctttccttctgctcttggacctaaagatcttttgcactgtcttttctcagccacagtacaaaagaataactaataatgtatggctttcttaaaaatattatgaaactttgcagccatttaaaattatacaaaataaaactcctgtgttatttgttatttgtatatgttcaaacatatacaaaatgtatataacagtatattaaactccattagtcaaattaaccaactcatggccaattatgtaatgcctgtactgtcatccacttcccccttgattatttcgaagcaaaacaagacatatttttataagtaaattttcagtatgtatttactatgtgttatttaaagatagaactctttaaaaattgtaaccataatactatatcactccttaaatgattaacagtaattcttaatgtcttcaaatatctagccattgataatatttttcctattgtctctcttttgttaaattaaaaaatagaaataactggagtccataggtttaattggttgatatcttttttatttagagtgatatatcccagttgtctgggtggcatccctgcttacacagtttggccaagcataatttttaatagtaacccctttcattctcaaagtgtcctgtttacatgaccaattatatagttatcttttgcataactgtcctttaatgtataggttctaccttttcctctttactttcccgttagattgtagttttgttgaagaagcaggttggctatcctacagatatttttgtaatctctaatttggcatttgcaccattttttattgttgaacacgttcttctgttctcagtatttctgggtaaactggttttaagatatagtgccatggtgagatgcaagtttggttgtttcagtgaaagtatttcctagatggtatttcatacttccaacgagtgagatataaatcttgataaatttttctcttgtgatgctaacaagcattagtaatcaactcctagattcattatttgattggggttaaaaattgtagacatgtaatatatatatatataaaatatatataaatatatatataatatatataaaaatatataaatatatatataatacatatatatacataaaggggagtagattaagtattaactcacacaatcacaacgtcccacaataggccgtctgcaagctgatgaataaggagagtcagtcccagtcccaaaactgaagaacttggagtctgatgttcaaaggcaggaagcatccagaactggagaaagatgcaggctgagaggctagaccagtctagtcttttcacgtttttctgcctgctttatatcctggccacactagcagttgattagatggtgcccacccagattaagggtgggtctgcctttcgcagcccgctgactcaaatgtcaatctcttttggcaacaccctcacaggcacacccaggatcaatactttgcatccttcaatccaatcaagttgacactcagtattaaccatcacaacttctaatattccttcctaatttttaggtagaaaatgatttcaaaaagaagtttcctccatcaacatttagattcccagaggtatagttgtttaggcaatgcagaataaatgcttgatgtttctcgttgtttgtcagtttttaaaatgttaagtttcatacttaacaaccacaaaagtgacaattgttagctcatggatttaaaatgttgtatgtgtttcaattcattacaataattattgttgaagctcaattttcctatcttctgccaatggtcgattcctcttgctggattctctgaactttaaacaagaaaataagaatatttaacagcatacttccatttaagtttggcaagatgcaggtatatcttagaggtattccaggttctgttccagaacactgcaattaggccaatatcacaataaagtgagtcacatgaatgttttttcttctcagtgcaaattagttaggtttataccacattgtattctgagcgtgcaataacactacttcttaaacagtgtacatatctgacttgaaaataatttactgctaaaaaatgctaatgatcatcttagctttcggcaagtcataatctttttgttggtggaggaccttgcctcgatgttcattgctgttccctgatcagggtgatggttgctaaaggttaggagggctgtcgcaatttcttcagataagacaacaatgaagttgccatattgattgacgcttcctttcacaaaagatttatctgtaacatgtgatgttgtttcatagcattttcaccatagtagaacttctttcaaaattagaatcgatcctctcaaaacctgctgctgctttattatctaagcatatgtaaccttctaagccctttgttgtcatttcaacagttgtcacagcatcttcaccagcggaagatttgtctcaagaaatcactttgctcattcatgagaagcagtactccatcctttcaaatttgtattgtgggactacagtaattgagttatattttcaggcttcacttatcattctaatattctcttgctatttccaccttattcgcagttacttcttccactgaagtcttgactctttcaaagtcatccatgagagttggaatcaacttctttcaagctcccattaatgttgatatttttacctcctcccatgaaacacaagtgttcttaatgacatttggaatgatgaattgttttcagagattttcaatttactttggccagatctatcagagtaatcactatctattgcaactatagccttatgaaatatatttcttaaataataagaattaaacttcaaaattactccctgatccataggctgcagaatggctgctatttagtaggcctgaaagccatattaatctttctttacagccccatcagagctcttggatgaccaagtgctttgtcaatgagtagtaatattttgaaaggcatctctttgtctgggcgataggtctcaacaatgggtttaaaatattcagtaaacaatgtggttaaaatggatgtgttgtcatccaggctttgttgtttcatttctacagcacaggaagagtagatttggcaaaattcttagtgccccaggatttacagtgtagtaaatgagcattggcttcatcttaaagtcactagctacattagctcctaacaagagtgtcagcctgtcctttaaagccttgaagccaagcattgacctctgtccagctttgaaagtcctagatggtatcttgtttcaatagaaagctgttttatctacattaaaaatctgttgtttagtgtggccaccttcatcaatgatcttagctagattttctgaataacttgctacagcttctggaaaagcacgtggtgcttcaccttgtacttgtacattatgaagatggcttattcccttaagcttcagaaaagaacctctgctagctttcaacttttcttctgtagctccctcacctctctaagccttcgtagaattgaagaattattgctttgaattaggtttgggcttaagggaacattgtggctggtttgatcttctatgcagactctcagatgtattgcttgtacacaaaatgcagaataaatggtaggtgctttatttcatttgctggtaaaactttctccacattggcattaatgctgttttatttatttatctttcatgttctcacttgagtagcatttttaattttcttcaagaattcttcctttgcattcatagtttggctttttggcacaagaggactagcttttgatctatgtaatctttcaacacgccttcctcactaagattaatcattctttgcttttgatttaaagttaaaacatgtgactgttcctttcacttaaacatttagaggccattgaaaacatttattggcctagtttcaatcttgttgtgactcagggaagagagagactgaaaaagaggaagagagatgtgggggaacaacaagtcagtggaatggtcagaacacacacaatacctactaagttttctgtcttatatgggcatagttcatggcatcccaaaactacaacagtaatatcaaatatcacagatcacagattgccatagcagatataaaaataatttagaaatttgaaatatggtaagaattaccaaaatgtgacacagacataaagtgagctcatgctgttggaaaaatggcaccaatagacaggcttgacacagggttgacacaaaccttcaatttgtaaaaagcataacatctgcaaagtgccataaagcgaggtgagataatacaacttatgcctgtattttatgcacattttgaacatgtcttgaccagattcttctctttggtggagaggagggagttgttgagaggggaagggtgtttgcagggagaggagtcatggcattttgaggatacagtccaggtgtcagtgatacacattgctagaggattggtctatttggaaacatagatagaaaatatgtctattttatgcaagtatatgagtcatatacttattcttgtacacttagaaacgtaggtttttatttgtccttaataatattatacctgcagctgatttattctacccaaacatgccagcttgctgtaacatcaccacagttatttccattatttcacagtaaagtcaaagcagtctcagaataatgtgatagatacactatcactgagaagctcaaatagttacaatattttttgtcatttttcccccttaagacatatcctactgtgggggtaatattcaaaatactgtatttttaaactcttacaaaaattcctcagttaagtgttatgccaacattcagtatactaatttgtttcattttcttgtctttacagaataagattttaacgacttcttttcatatatatataatatttacacaattcagaatcatatatatgaacaaaataagcctaaggaaatttagtttatatctttgttctctggttgcctctaaactgcatacttcaattcctccctcatatacaagcgtttattaaaaataatttgatcatacatatatgtaaactctatgtatgtatataaattttctctatatgtattccccattcttagataagtaaaggtatacacagtttaatctgcctttacaacatatcttgaagacaacttcataaatcatgtataaaagtacacctcataccttctcagagctgcctagtaccctgttacatcatagtactgtgacttgttcaactgttctctgattcataaatatctgaagttctcttggttttctattgcaaacaataaccttgtgtatactaacgattctaatttaaaagcaatgcaggactaccgtaagcaagaaagatgccagtacttagagggttttgcactaattctctaacctgtcgaaattcaggattctttccttctgttggttagactacatttgaattattttgattgcattgaactacaaatattttgatcttctgagtcaaagaccacttcaattactttacatattaaatgcagtatcatacattatgtagctattactcacactctgaacaatcttctgaaataaggataggacatatgatcactgcaaagatattgaactctgcaacttatgtcattgagtactagatatctggtagattttgtctaaaaacaactcctcatttgggctaccacatcttattaaaatatcttattaaaaatattaaataaaatatcttattaaaggtattaaataaaataccttattaaaggtatttataattcctttaattacttcctgcaaaaaaaatacaggctaattatgaaatccagtcacaaattttgttcacattctttggatacaaaggaaaaaatgttattttcctttgtttctaacttataagtgaagaaaacatatgcaaattgtgagaatgaattcttttcaaacaaagcaattccattttaggaagggatttgcagctattacttgttttcctttctaaaatgtaagatctatgctacttttttttataatgagacacaagaatttatcaaatcttaagaacaatggttacagtctaatagtcacattttttttctgcaaagagaaacaatttcatgtagtctagttaagttctcatgtcagatctaaagacttttctgagagtcttacataattgcagaaacaaaaaaataatggagtggttttgtgagttcaaacttcatcaaatttgtgtattagaatgcctccactcgcttggcctattcggaagtcccagtagaaaaatatccaacagaatttttatattagagtggttaaatttacatctaatgcatatttgaaaaagtatacatttgcttatgattgtctttcatacatctgtgtgacaaatattgaatattaattatataaattaattcctagtaatagtaacctaatatgtcattcaatacataaaaaataaaactattttttttacaactactatgctaattttggccactttcttgaaaacaagctaaaaataatcagcaactatcttgtagggatagccctatgaaatgtattttatcctccttaatgttattaggaatacagtttaatttatcaagaaggatcttttagtggaagaaagttgggaagaaattattttttgtttttctattcttcttttgaaatgtttttctcttgattatgtttttattttatgaatgcagtaaactttgtaactaatatgatttaccttttaaagttttgatttttaaaaggtatgaaaactaaactgcagagcaattctagtcatatcagtatagttcatatttctgaatatgtttatgtggttatcattgttttactttatctttctcataagacataatttactaatatatatctgattcactaatatactaattcactatttattattgaaaaaggtatattaccatcaggtcacaattaataatgacaagaataataattatactccatgtccaaggtcattctgtatccacaatgtcacaaaactgattaatttatttttaaactttgatatgtgaaaaaacagtcttttcattttaactcaacagatatttaacagaattagattttttattagaagtttacatgtcagaaaaatttcttctttaatttattgaaacctttcagcaggaaacaaagcatattttgtaggttgtcagcaggaaaataattagtgggtaagatgatgacttcataacctgcaattacgcacataaatgaattagaacaaaatgaagtattatcaatcttaatgcacattacagaattgagagaaacattagtaccatgacagcaaattacttaagaatcagtgatgttagatttactaagatatactttaataatggtcaccatagaatgaattgctaaatgccattcctacccgcacaagtatatctcactttatttgaccacagaacagttgaaagagcctttgaatgcaaccaggagttgcaataagaggcaattaatgatccataaaaggggatccatctttatgtgtagcttactttactgattttttttgggaatgctagtccacatcgaacaaattaaaatagtaaaaaacactccaaagaaagattcctatatacaggactaataactttgcagaaacacaaaaagcaatctggtattcagaagacctttgaactccagaaaaagagtgcaatcccttttcacaatttccctaaaataggaaagattatactgcatgattcagagcaagttatttttatttggttattaacagtaacataaaatggaaacaatagctcgctaagcttgctaatgtttgtaaatgatctcacattttcttattcacttcaaattagatttgcatatacagtgcaatattatatagtcctggatgttatatattttacttacacactatgaaataatagaatacttaattcataataatgttgtataacaagcctgacctagaactaattgcccagtatgagaacttcactataattagctgtatatttgggacctttattgatcatatcataaactgaatagttgtaataaatatctgtatttgagatcctggttttatgtcccaaaaggttagcagactgcatgtatgactactttatacctttctggattttctttgtttaaaaaaaaacctgaagtaaatgactatttttatattatttttataagattactgttcttcatgttataatagcttttatacactctttgtgtttccttctttgtccttctcccattggctatctccctccttggaatcacattacatgtgttttgggatttattaagcgacacatatttcatgtgttttgtgatttattaagtgacacacgtttctttactgatcagttgatatctgcttcttgttcctatgatataacagtgattatctatgtatttaaatgaaaattgtaattaaatcctacagtttctgattcttgtaactaattttggaaaagataaaaagacagattttaaaaaatatttcttcactccattcgaataacatttttcagaaataatagtgcaaaaaccagtatatgttctgaaaatgttgcccttttactgaatagaaaagattttttcagagacacaactgtttacagctgttcagtttcaaatagagactaatgcatggacaataatgaaaaaaaaaaacactttcgatgaaaatgctgtaggaatatcgatgcatatcacttgatttcttttatgccataatagttcattcctttatttcatctcttaagctaccaaaatttcatcaaatcatgggcaaggaatctgcttcagtttcaatcaccagtgcattaaagagtcacatccagggtagactttggtaagaggttttaattgtgtcaaataattttatgcatatgttcagatcttatagtttttttctttattctgttaatgtggatgaatccatcaattgacctttgaaatgttagatcattgaaattctttagataaacccctacatgtatttatccttctcctatattttattttatctgctaatattgctttaagggttttgggatttacatttattagggttagtaataggcagttttatttcttgttacttgtttaccttgttttggtagcagagcaatgatgatgttttaaaatgaggtgggaagtgctattgtattttctattttctataaaacattgtgtagaactgtgattatttcttccttaaatgttggataaactttatcatgaagccatctgggtctaaaatttttaaaagattttatcaataggcataaggctattacttggggcttttcctattaatttttagtcagtatcagtaatgtgtttttttaaaacattggatcattttatctaaatcatcaaatttataggcagatttttccccattaatcctttgttgttaaagtttctctttcatttctaattttgtgatttgtaccttttctcttttcttgcttttaagtcaaaacagaaatttatccattttagtgttttattgtaaaaaaactgttcttaaacacagtgcctatagttaacaatacagtactgtgcacttcaaaatttgttaagaaggtagatttctttttaaatattcttaccatacacagagaaaaacaaaaaccaaatctaagtgacacaagaaaactgtaggaggtgttagatatgtctattaccttgtttctgatgatgttatcacagatgtttgcatatgtccaaactcatcaaattgtacttattaaatgtgcagagtcctctgtatttcaattctacctcaatatagctgttaaaaatcaattaggtacaggttgttgatagtgttgttcgactattcagtaatcttgctgatattctatttgttctttaaattactgagagagatgtgaaaatctccaattctaactgtggatgtatttctcctttcttttctggcaatattttcttcatgtatcttgaagctctgttactggaggagtacatatttatgaagtttggtgtttgatattcttcttgatcaattaacttctttacattttgaagagtacctttctgtctagggtaacactacagattttgaagtctaatttgttttatattagtatggccactccagtttccctatgtataatcttttcatgacatagcttttccatccttttatacttagtatcttgtgtctttactcctgcagaggatttctggtagacagtatctatttgagtcttggtcaatgtaataatctctgtcttttatttgaaatatttaggccatttaaatttccattattatccaaccatcattacagttgtggtcaatccatggacctgcatttcattttttccacatgtctcctttttgtttgtttctaatattttcttgagtttttgagtatattttagaatttcatattatctacatgattggcttataatgcatacttctttaattttgttttggcagctgcattaggctttaaaatgtgcacgtttcatctgactaatgtctaatatccagaatctataaggaacttaaacaatgggacaaacttaaaaagacattaaaaagtgagcaaaagacatgaacagaaacttctcaaaagaagaaactgtggaggttatggggagaagggaatgcttatacacttttagtggaaatgcaaattagttcagccactgtggaaagtagtttggagagttctcaaagaactaaatcagaactaccattcaacccagcaatcctattactgagtatatatctaaaagaaaataaatcattctaccaaaaacacaaatgcactggtatgttcatcacagccctattcacaatagcaaagatatggaatcaatctaggttcccatcaactgtagaatgggtaaagaaaatatggtaaatattcactgtggaatactacacagccataaaaaaggaacacaatcgtgtcccttgcagcaacatggatgcagttggaggtcattatgctgagcaaataaatgcagaaacagaaaaccaaataccacatgttctcacttaagcaggagctaaacattgggtactcacagacataaagatggcaacaatagagggagaaaagtaggaagcaggcaagtgttgaaaaactgaccactgggtactatactcagtacttgggtgatgggattaattgtaccccaaacctcagcatcatgcaatatacccgggtaacaaaactgcacatgtacccctgaatctaaaataaaagttgaaattataaaaaattaaatgtgcatattttgcttattaaaatctacctgtaaataatattttgtcacttcctatgcaatgttagccctaatatttttgtacttttcttcccccatccaggcttttctgctaatgctttcatatattttatacctatatggattatgacttctgaaatatattattatttatactttaaataattatacttaaaaattttaaaatatagaaaaatcttcaatatttacccaacacttaccatttactgctttttttaatagtcccatatatccattttctgtcattttccatctgcttatgtttcttgtcttgcaaattgtgacacattttcttgactgctaattgtgtgaataaagtttttatcttgtctagatattttcactgagtatgtagttcttggtcataaggtttttctttttgttttcttttacttcttgaatcatatcaatccattttcttctagcttgtatagtttgagataagaagtctagtctaattcttatccttgctcttgtgtatgtatcagtaattttcctgtgactaatcttaatactttgtcttcattcctggagcttaggaatttctgtttgatgatctttgatgtggattgtttatgtgtgtgtatttatgtatacctgttatatattattttaaatttgttaaaatttctggttatggaaggtatagttctcatcaaaattagaaatattttagtcattaccttaaaaaatatttttggttgtcctttttaggattctaatttcatctatgttaaaccaattgatattttccaacatgtatctgaatctgtttattattttcagttatgtttctccgtttcatttttaatggattttgtatgttcaagtttactaatattttattctacaatgccctagttgttgttcatctcactcagttaatttctgatttataatattgtattttccaacattttgtgaaggtgttatatatatgtgtgtgcgcatacatatgcgcgcatatgtatgcatatatgtatgcacatatatgtgcgcatacgtatgtgtatgtacatatatgcatatacgtatgtgtacgtacatagatgcatatacatatgtgtacgtacatatatgcatatacgtatgtgcacatatatatgcatatacgtacatatatatgcatatacttatgtgtacatatatataacaacttcacaaactgttgacaatgtacatacccatatatatgggtcatattttctgattctttgtattgaaatattttctcattagatgttagacatgtattttacattattgagtgctacattttatttgcgtttttaaaaaatgcattggacttttcctgcaaggcagttaacttacttgcgtatcagcttgatccttttgcatcattatgttaaagccctacaaggaccgctcaggagtagcctttaatctagggtttatttagcctcagttacaagctatgccccatgtggtgtctatcctgattgccatgtatattcaaagaggtttctgtcctgtggctgaaggaatcttgagtgattctccaaactgtgtaaactctgagaattgtttatattgtagctccctgaaggaaaatcctttccttaagaaattgttctttcttatcctcatgggatttcatgagaaagttgatattttaaccaaagattcaagatacatgaatattttaaaatctctttttctgcctggctttcttctctctgaaattctgctttgcaaattctataagcctctgaaggggttaaaatatgctattctgccatattgactatttaagtttaagacatttgacaaacagcaggtgcaagatcactttgaccttcatgcagtttcatatttccatttttcccatgtaaaagataccctccctctactataaggaaagacaacatctttatcctcaaggatgaaaagctgagaccaaaagaattctgtacagacctagttaaaataactcttatcttttaagccttcccacataattgtttgcttcttcacaatgtacaattctttgttccaatttagtatataaataactgactgcttctttgggtcttcatttcatttctttctttcttttttttctataagatgaggtctcactctttctcctaggctagaatgcagtagcaaaatcaaagctcactgcagccttgaactcctgggctaagccattcttcctcctcagcttcccaagtatccaggacagcaggtgcatgccactatgcccatctaatttttaatttttattttgtaaagacagggtctcgctttgttgcccaggctggtctcagactcttagtttcaagcgatcctctgccttcgcctcccaaaatgctgagactacaggtgtgagccactatgtctggccctttcaattctttgtgaaggctctcatgcctagtaaaacttgtattaagtcaatttctatgcttttctcctgttactctatcttatgccaatttaattcttagtcctagctgggaacctaagaggacgaaggtggaatttttctacccccacacctagttttcccaaactccagtttatttctcttcaacttaacaggatatctgggctctgtttgatttctcctccacaaaaagcagtaaaagccttgctaccaggcagggagctcgggcaatggtagaattcactttcttggtttctgttcttcaggtggtcataacgctatgcttcctgctcctgaatgtcagaaaagtgtatttcttctatttcatctaattatataattgtttagaaattgctacatattttatcctttaatgaatgttcatgtaaagtagccacaaacaaattaaaagtaaaaattaagtaaaatatatgcttttaaggttatgtaatttctccatgttaaacaaaatactcacaaactatacctaatttatcaaataatattgattgaattgaaatttttaacttaattttttacctaattcagggtaaaaattcaaagtaattattatcattctgattaaatgcacacactcatattcataaaattttggatggcaaagactcatctttgtcacattgattgctgatttagctgattttagaagtaggtgctttaaagatgcaagagcacctaattcctttaggagccagagctaatctaatacaccgcattttttgtttgtttatttgtttgttgtagtcaatagtctcactcttgtttcccactagcagcagaaagaataaagattattgtgaataacgtgttatccattcacatggcctctaaatactaagaatagagcacattctctttcatacctatttatgaagatcatagttaaatttatctgaattgcctattgataggatcattaatgatttatttgctaaggtaatatataagactgattttctaaggagattgatatagtcgacataataaattttagaatatgtcaacatgattaaccacctagaatgatatttgatgctccaaaaacaacagatcataatctgctctcctcatattaacagtgatactatgaggcaaaaatatctcctcgcggatatttcctggaatagttaattaacttagctaccatatcataatcttcctccattaatgcagtctcattaacaaactttcgtaggcatctttggaacaattttgttttctgaagttgtgtcttcctgacagaccatgagctgtaactacttacagctcttcttcaatcatgtatatagttgtccattctatgaatcaacattgctattttcaattgctgttggtaagaaaaatgtcagtttatttccaaatctataaatttcactctgaaaggcactacaaaacctaatgtattattttccacaaatcttagctgtttcacaacatagattttagatgtaagctgccttcaggcttctgtattttacaatgattattatgtgtgtgatacattttttgatctgggaagagtttaagcattctgagtgtcacattttctactagtcaaataaataaatcaaaaggttataacacaaagtttgttctagaggtatagcaacatgaaaaacaaaattaaacacgtgtggggtttttcctacatgatctctgctgctcctgcctcagtatattttaaaaactcctttcacagagaatgcatcctctacatgtttttgctttatgattgcttactgagaatctaataaagtgtaaatgatttataggtttgtttgtttgtttgttttttgtttttttctttccgagatggagtcttgctctgtcacccaggcgggagtgcagtagcaccatttgggctcactgcaacccctgcctcccaggttcaatcaattttcctgcctcagccccccaagtagctgggattacaggcgtgggccaccacacccagctattttttgtatttttagtagagatggggtttcaccatgttggccaggctggtctcgaactcctgaccttgtgatccacccacctcagcctcccaaagtgctgggattataggcgtgaggcaccatgcctggcctatataggtattttttaaattctctttacattgtttggactgcctctttctttttgatctctctgtgctttgcacatatttttctcataacacttaaaaactctactgaacttacatgctcatgtatttatctctctcaactagagaacctaccaagatctgcatattttatcattttgttccaattatcttgtatattacctgcacagtgtagtcatctaagaaatgtttattaattgaggccttggtatagaaatatcccattgaaaaactgacttctggtaccgatatatctagatgtgcaccttttatactctgtctttactgatctctggcatttgctttctcctgaattagctttactgtaaggcaatcgcaccctttgttttgatgggataacaagagatagctccaggtcaaaacctactagttccagcaggtagacagaatctcacttcccaaaagtttccctaaaagtattagaatggactctgaatatccttgtatgggctgcatgcctgtattactccattttcatgctgctaatacagacataccaaagactgggtaatttatacaggaacaaggtttaatgaacttacagttccaagtagctggggggcctcacaatcatggtggaaggcaagaggtgcaactcacatcttacatggatggcagcaggtaaagagagtgaacttgtgcaagggaattcctctttataaaacgatcagatctcgtgagacttatgcactaccatgagaacagtgcaggaaagacttgcccccatgattcaattaccgcctgtcaggtccctcccacagcacgtgggaattcaagataacatttgggtggggacacagccaaaccatatcattctacccctggcccctcccaaatctcatgtcctcacattttgaaaccaatcatgacttcccaatactctcccaacgtcttaactcatttcatcattaactcaaatatccacagtccaaagtctcatctgagacaaggaaaatcccttctacctataagcctgtaaaatcaaaagcaagttagttacctcctagatacaacaggggtataggcattgggtaaataaacacattccaaataggattaattggccaaagcaaagaagctacaggaatgacgcaagtccaaaatccagagggccagtcaaatcttaaagctccacagtgatctcctttgactccatgtcttgcattcaggtcacactgatgcaagaagtgggttccgatgttcttggacagctctgcttctgtgggtttgtggggtacagcctccatcctggctgtcttcatgagctggtgttgagtgtctgcagttttttcaggtgcatagtgcaagctgtcagtgaatctaccattctgctgtctggaggatggtggctctcttttcacagctccactaggcagtgccccagtagagactctgtgtgggggctccaaccccacatttcccttctgcactgccctagcagaggttctccatgagggccctgcccctgcagcaaacttctgcctgagcattcaggcatttctatacatcttctgaaatctaggcagaactttccaaaccccaattcttgacttctgtgcactctcatgcttaacgccacgtggaagctgccaagtcttggcacttgcatcctctgaagccatggcctgagctctacattgacaacttttagcctagtggctaggatgcagggcaccaagtcccttggctgcacacagcagagggaccctaggcccaagctaggaaaccactttttcctcctgggcccctgggccttgatgggaagggctgatgtgaagacctctgacatgccctagagctattttcccattgtcttggcaattaacatttggcacctcgttacttatgcaaattcctgcagcctatttgagtttctcccagaaaatgggactttctttctatcacattgtcaggctacaaattttctgaacttttatgctgtgtttcccttttgaaactgaatacaattaacagcatccaagttacctcttgaatgctttgctgcttagaaatttcttccaccatatatcctaaattatctctctcaagttcagagcttcacaaatctctagagcaggggcaaaatgctgccagtctctttgctaaaacataacaagggtgaactttgctctagttcccaacaagttcctcatctccatctgagacgacctcagcctggatttctttgtccatatcataatcagcattttgatcaaagtcactcaacaagtctctagacagttccaaactttcccacatttttatgaattattctgagccctccaaattgttccaacctctgcctgttacccagttccaaagttttttccagatttttgggtatattttcagcagtaccccactctattggtaccaatttactgtattagttcattttcatgctgctaataaagacatagtcatgactaggtaatttatacaagaaaaagttttaatgtacttacagttccaagtggctggagaggcctcacaatcatggtaggaggcaaggaggagcaagttacatcttacgtggatggcagcaggcaaagggagagaacttgtgcaggggaactcctctttattaaactatcagatgtcatgacacttattcactatcacaagaacagcatgcgaaagacttgcccccatgattcaattacctcccaccggttccctcccacaacatatgggaattcaagatgagatttgagtggggacacagccaaaccaaaaccatatcaatgcccatgtttgtagtaaatcagatgaggttagcaggaagggaaatatgtagcctggctaggccttcatcacaagggaaccatggttgttatgtgggagggtggtagtgaggttaactccgcctggaatgccaaattaggaagagtggagagtttaattcctaaagggaataagaaagtgattcttaacagacaaaaaaaaaaaaaaaaaaacccagattatcactacaatataataaggctttggaaaacagcctataagcaaatgaaaaacacatatttttctgcagtgcaactataactagtttagataatgctaaatcagtttaataaattctgtaatattaactgacaatcatttctccttcatttttattctttgaaaatgtgtagtttcgctcaaaagctcctcttactaggtctgttattttactaaatttgtgttttccagtttgataaattgagttaaagtaaagatatagtgttatgtttatactttgcacatgtagtcgagtgttaaaatatattttgagttaaagagaactattataataaaatagtagaaaatgtatacatgagttccattaagaaaaatgaaaagtaacaaaacattttttccttctctctgatataaatacatacacacctatacatagaaaaagaaagaaaggaagaaagactttaaagcataaaagagaaaaagacagaaaaatcaatagcatcatctatatatatttagtattgatagatacagtagacagccaaatgctatccaggtcattgtgctcagggggcttgcctaaacatgccaatggagaaaaattccatccattaacatatgcgcagtacggaaaataaatctgtgtggagtggctcagaataagggcccacctggcactgggagaatggggtggagccactggaaattcccaccttattcaggggggaggtgtctaacgtcttcagctcatgtattatggcctggtattcaaactgcgaggtgggagcctgttggcagagcccccttttttttgctaagaactttcttttaataaattccactctcctcacctttcaatgtgttcacgtgcctaatttttcctggtcatgaaacaagaacctggagtttagctgaactaaggagcaaaaagtcctgcatcactttgatggctggaacagggacatgaggaaaggtgagtaaaatgcgaaccaaaaaatatccttcccttttgtttctgagactttatatcctcggacttcttctgagggtagaggaaactgccacccacccctgcccagttgctctcagttgcgaggaatgtctgccttggcccaaaccagtcttttgtatggcatcttcctcctttttgggactgtaatggcacctatcttttcattaccctaatggctgcaggcatgcacgtgggaagaacacatgaacggcagctccctgcaccctctcccctttcagctgggtcccagacacatggcccgaggggcctgtatagcaggccggccagcattccctgccacacatccacagggtcttccccttcccctagcagagaggtccagctcagtccaacagcaagtaaaatttctctccctgtaggagaaacccattggcaaaggaattagaggttcttccttcaggcatctttccgccctgaactttaagctgtttttttgtttgtttgtttgttttttcttttctccaccctgtcgacagttaacatagccctgcacttcaagctgtttttttcttttctccataagctcaggagttaagttttatatgagaggctttttttcccctcttttagaaaacattttactaggccaggatcccaaatatcactgtttatattctctgtaaagttttagttatgaaaaaggatttgtgagtttggtcttaagctatagccaatctggcatgctttgcctgtctttctgtatggctctgtcagaaagaaggacaccttaaaatgagatgcaggtctaggactccataggcctgctgttcaagtcagccaggaaaactggtcaatagcaaactttgctgtaggcctccatcttgttttatgtccttggaagtgtgacctgtaaccacatagcagtgctttgttttagcctgtgccattttacaatggtggcccaggttcaatactggcttatggaatgagttctttctggttggatatctgtgtgacctttgccatttgatgatttttcttcccctctacaaacagtcctgaaaattcctttctctgagctcctgggaggttacctttgctaaagttagaaagccagaaatattggccgcttgacatggttaaagtcaggtaataagggatctaaaaggattttcttaaagatcactcagcttaattaaaaatggatatgcaagttgtaggtgtatttaaaaggcctttatgtttttctcttcttggatcttgtttttctggaaaaaggtttttttctcagtctactgaattttttttttttccattttgccttggcactcttaattcttgcatgagaggtcctaagataatttctgatggactgggactccttgggaaaagcagaaaaggtgccacagattctattttgggagagacctctgttttcctcctggctcctcaggaattagaggtggatagttccctctcaaaaactgtttttgtcttccagctacacctgtttattgggctgtaaaaatagcatgctttcctagccttgctcttaaaggattccacctggaggacaatactccaattacgagattggcaaatggaaaatcttataactactggatctgcttctctttgtctgtgtggttatatatgtgttgtgtgcggtatatataaaaagagctctaattaattgacttaaagaaggataagtgcttggatcaaaactgtggtaccttttagttcatgtgactttaatccttgagaaataaaaatggccttaaaggtattggtaaaatgcagatgttgtcaaaatgtaaatttttgcctagggttaaaggattgttttgaattaaataagatacaactaaaacaagatgtagacagattgtaaaaattaatcttgaaaaagaatttccatgtgtgaacatactgactaaattcaaaagggtattgcgtggcttttctgtaaattgagcattgaaataaaagcacaacgaagttctcttaaggcaccaatctgcactttagcaaaaattgtaaaggtttttgaaaggattttgctttttaaaaatctctgagtcatcattttgacaaaataaatcactgtaatctgaaattctcttttacaatatcaagagttttaaagatctaacataagtaacagccttcccaaaatcaaacttcagcttcaaaatttgtctttcctggcccctggagcatccagaagagtggtaaacatgattacctgacatgattaggtacatggcattaccaaaatgatgtttaattgttttcaggttatattttagggactaatgttaacatatgtttcaaaattatatgggatttctaacattctaatgtctgagtatatactgtcatcacaattaaggttgttaggttaagttattgtaaaccacggagataaccaaacttctttgcctatcgtgtttttgaatataactaccctggatatgttgttatgcacagacaattgttgtcttattttgatcctctttaggagatgtttgataatcagctacagaattttgacaggtgctctcaaatgcaggtttctgataactttggagattgtgatattggaataaagtaaacatgtacaggactcatgaagtgctgaaacattcacaaatatcaagcaaaataagagtaaactgaatggactgaaataataggaaaccgaaaaaatctttttgacttttgtttggaacattgctgatcctttttttgttttgcacagtcaagaaaacttactttgaactatttatggtctttaataattgggtaagctatactcctgtgaccaaaatttggagcatatttgtttctctctctgcctggcttctccagaatttggaaactagtttgtgagtattcttatcttatgccaatatagttgtttgtatctgtgcaataagaatcaattttcttttgtaacagcacacaattagagaaactggttgttttaccaaggctttgactggaagggtatggttctctttaaggagtcaagctcaacttgcagagccaataaatgccccttgggaaaactggcctcataccttatctacacagtccccatacagggttcttaacctgaggggagtaaagaatgtcaccttctaacaggcccaggaaccccatgttcttgggacctcaagaagagaggagttcacccaactcgtaggtatttgagggtacaaacccatggctgggcttggctttaacaaaagccctatctgagattccttgtagaacagaattccatgaacaccagtttaaaaaggctatgtaaaatcaattataattgctgcactttatgcaaataatcaggcccagtataaggctaaagtctattctgcaaacaacgcagtcttaccatgatttgtttttaatgaaaatgaggactggagagaaataaattatgtttcaaaactgatcatacacttgttattaaattctagactcactagttgtttttaagtttcttgcctacattgtagactaatccttggttgttcctgtgaacaaagcagcaatctccaactgcagctcagaaggaacaaaatggatgggtaatgtaaaaatctgcatcaatattctagttctgagcaattacgttgcaaatcctgccaggtgatggaaataaatagggtatccatcaccccaagttttcctttttgaaagtaagaccaagggagataaccaaagccaagccccatgcacccaaaccttagcaagcataaccatagccaccagttatctgggcatatcacaaggcatccttttttctcccttgttggaggaaaactaaattcccacccccaccctccgcacccccgcctggccccctgttaacctgggtgaaagctactttaacatccatcggcagcacgctgttgcggtccctgggacttggagatataaggatggaagacagaaagagcagtgcctcactttgtctccctcgtgtagcccgcgtattcgctaggaagagaaaggaacctgggatgacttgctcccctctttctagagaagaagccattcatcttcagtctgtacccctttcaaatgcatcctgaacccctgggactgctttgataaaagtcccctcttttcccctcctttgtcctctcttcactgataggtaattgtgtctgtattacaggactctcctcccagatgcatcctccaaaactgggcaaagttaacttcccaaaccttaaactggttggcttaggattggcctcagggaaagggaacccagaagcctgacatgctggcaaacgggtaaaagtcattttttttcttttccagttgggtttttggtctccctctctgtgtgcaaactggtaaaaggccttgggatttttgagctttccttaccccccaaaacttgtttcactttgatacatgttttctaatagcccagtttgtttcttctcaccttcaatccatctgactccaaactgtcatgcaaccagagcctcagacaatggccaatcttgccagggacccttagataggcctctgagggagatctgatttcccaaacagcgccccctgccagcaggaagcagttaagatcgatcttcatccttaacccttatccttattctaatagcagttagatgtactttttagagtggggaatgatagagacaggagacagccaaatgctgcccaggttattgtgcacagggggcttgcctaaaaatgcggatggtgaaaaaaatctatctcttaacataagcacagtaagggaaataaatcaatgtggagtggctccaactaagggcccacgtgcaaaatgggagaactgggtggagccaccaggaattcatgccttatgcaagggggaggagcctggcctcttcagctcatctgtgaggtgggagcctgtgggcaggacctgttttttgttgttgtttgtttgttttttgttgttgtttgtttttgctgagctctttctttcaatagattctgctctccacaccttttaatgtgccctcacgcctaatttttcctggtcataagataagaactcagattttagctgaactaagaagcagaaaaccatccatcaatatgatatacagatattatgtgtatacgtctgtataatatcatttacagatgtgtgtgtatatatatccccttgaaaatattttatttctatgtatttaaaaatgcaaaatagttttaaaaaaactaattaccaaatgcttgaaattaaaaaagaaaaaagatctctggtttaacatatatatatatatatatatatatatatatatatatatataaatttaggttaggatcacacattcttgtgtacaaaattattacaaatcatgtataaataatatctgagacaaaaccaaacatacatacagaaatgttaatttaattaaaaaagaataatacattctttgcaacaggagctattctaaagaagtatcaaactaaaataagaaagtagaaaataataaaggcaataattaaggtatttaaaaccagaaaagaataaaattgactattttgagactggctttgggccatatactctatcttagaattcacagaagtaattaatttagccaatgttttcagcttatagagctgtctactcagaacattgaacactattctatttccatggaagctttttctgacctgacacccacaattgttttttttttctcccagaatgtttaatttaaaatgacttcgcatttttcctcatttaaagacacacatggacacttattttttgtaaaactcaccaacacccttaagaaatttcaaaaccctacattctacttctgcgctatctgaatgcgtatcgtcatggtcatcccttctttaaaaatgattttttacatgcctctcacctctttgtgctatcagcccttcagggcacaagttgtttttcattatcctttacctgcacagagcctagaatacagaaagtgcttaatttttatttgttgatgtaatgagtgtgtgtgtggtgtaggggtgtgtgacagtgagagagagagagtggtggtgggggttagggggagttcatgcataggtgcactcacacacaagtatttatgattaactatcagagttggcagatgggggtaatggttagttttactcagtataataccctcaaatccaagtacttttattctatgggtattgccaggtctctttgataaccttaatagagcatcaggaactcttttagtttcatctaaattgccaatgtttaactttctaaacatttagaaatgatgccgtaattgtacagtatcctgttgtgatttgtgtcttgaatactaaatgtaaataactaacgaaccaaagtcagaattttttgctgtaaaacaaatgaattttacaaattttattaaaatcaggctttgttaaagttgctagaatgaatgtaaatcagggacaagaatgcttgattgatcagtgtctcatttcctgctaagtaaatcaagtaattgtgtcttgaagcctcaaagcactccaataaatattcaagaacaactcagtgatagattatttcacaagaaagaagatttagacaagacttgatgcattctacctgtctttggcaggaagtttaaagtacaacttgaaatgtatggagaccttgcccaaggcaacagatacaaatgattgcctacgtggagaaatactttttaatcagtagattatccaacaagatggcaaaattcttacttgttcagcagttcaacaaagcatttctgtaggttattctgttttcaaatagtaaaaatgtctttccaactttccccagccacttgcctcatttcttttaacccctaaattgcaaatctcttgcgttctttttatcaattcagtatagatagaaaggaagacagcagaattcaaacttcagtttttatatcctattttaaaatgttagattccttgaatttaacgcacagtgtgatatagttaatacttgagaattgtacctttcaaaattgctaagagtgtacattgcaaatgttctgaccatgaaaagaaatgtttgaagtgatgggtatgttaactagtttgatttaattattccacattgtattcataaatgataatatcactttgtaccagataaatttatacaattataaattgtcaattaataataaatatttaagataaatataaacctaaaacataaacataaaacattagatttcaagacataactccatttatagctctttagtgaaaattgttgatagaatacagacagaaaaaagttctactattaaaatacacacacaggaaatttcatttctgaaagattatgttatgaattgattttgatattgtcctcttgaggttatgtgtgtggcttcctttaaccaggaaagtctatctaaaatatttgtgaattgtgtgatacaaacacatatgctttcttccttaaacaaaggttgcttttgttccaaataaaaaataaaattgtggaattaattccagtaatcaaatattttgctgaaaccaataattatcaaatgtttcttctagcaaatttctgaaaggaatcattacattgttctgtcaaccatgaaattgactcatgatctttctatcctatcactggatttttaggtagccttctcaattacacaaataacaaaacagaggtgatatattaacatctgaggtaactttctaggagtgccaatttaaattgatattgaagagtggaaaaaatataccctccaaaacacgtcactttgacataaggattactttgagctgaagtcacttaaaaacagcagacacaagaaaggcattctaatctctttctccctgaaaacaggagattaaacactcctgtgtgaaaaattcctttcctgtatcaggagaaatgaaatgttcttcaatggggtgtcgtagctgaaataattaggtacaaatagatcttgttagagtaattattatctttctttagcctccctatataatttagttacttttccacaattgcctctctttgctcaacctaatataaaagcatttcggttttatcacttctttgtgtcttcatttctttatatttgtatgatttcctctgttaatttaacttatgccaacttaattctcaggccttgctagaaacctaaaggatagaggtaaaattttgcctcccctactgttgagaaagagaaaataaaattattttccatgtatcccttgcaccttttcttcacttccaacacattctaaatttttctggtaggctgttaaccctagcgttaagaaaatgaaataaaacaaagaaaataaataatagcaactgaaactcacagacatattgaagtaagaaaacataaaggcaaaaagaaattaacatttttcacaaaaaaaggaaacagttgacgaaagaaatgtaagttaaaaaaatcaacataaagggggtacaaaagtcaaatgatgaagtatattaaaaaggtaaaaaatgcattttgatggaataccattaagccatgcaaattaatcattgttaatatatgagttataactatctttttacccaaatccacctgtccaatttcttagttatatatctatcaagtccgaatagaaaatattgagttcaaatattgtactgtgtctgaaccaatcagcacttctccattttgcatttaaaatatctgcacacattaaataatactagttggcaacaaacaatcaactttggccaaaagtcctaaatttcaacaaaagcatcctttgacacaggttggctaagatgtcttgagtctgtgcatcttaacattttccccgtctagtttgtgaataggctgtgtccattcaatatagattcaaaagtaagcaacagctgaatattttaggttcggagtaccactagcaacgatcaacagactggatttaaattatttaggactttggggctctcctgagaactgttggatactagggtattcaacatgattttggggataaaggttgatcagagaagtcgtggctcagaaagcactgtttgaatcaaaatctaaagagttagagacattttagaaattgctaaggagggagattagctcggaggagagataagacgtatcagggctctcaaaaaggagcaaatataggacatcttgagggtgaataacagtcttggggctgacaatgctggcttgtagacaacccagagggaggctggggtgagatcagagtggagatactactgaaatgccagaggttccgtggaagtcccatccatcactgcacagaaagccagtgagacaatgactattgccagggaataaggtgactttatttatttgggtgacttcagctggagaaatggctgaaaactgtttctctcaacgaactaaaattggaggtttatatagcagggaaggaatgcagctacttgtgggaaaacagaaattagggaggggtaaggaaataatcatgagtagtgaaggagctggagacgcatcgtctggatctggtgatctggtttcagttccttgcctgaggggtcaatatcctgaggcaggaactaagataagacaaacataaatttcaagagtagtaggttcattttttgtatttattcaaaaaactataaatatcagttctatggcacaattgggtcattttcaaaaagtaggctgcaaatggaggggaggtggttaatcttaattttagaagctacaagaaactttttgaaagattcaaaatgtatagcaacatgataggagtttacgtattttaggatactgactgcagtgtagaaaatacactgagattggaataagaatggaagaagagacaccagagaggtgtctgtctattgtacttgcccatggcagagattgtcatggttgaaaagaaggcggagtcagaagagagatgttaaaaaatgtttaagagatactgttgacggaacactttggtcttctacaattaccaatatcttctgttagatctgagtcttctaattagaacgacttggtagtagttccagtcgtagattctatcaagtggttctaatcacttcagatcttaatgatttttttttatctgctcatattaaaacatagtaaaatagaggcttcctctttaagaacgcacattccttggtttaggaatggccagcatccctattccttcccaactctgaggggctgcttccagttcttagatctgaattcatactgcaacttttgttttttgcatcaattataagttttaaacctagactcagttgtctaatttgcccctcctttatgacgtggatatctgaacaccaaacctttacactatgtttatgttttctagctagcttgtgccagtaatgattacgaagcaaaggaaaccaagtactttaattgttcataaagaagttcacagctagagttattcacttgtgttaaagcaataaatggtaaagaaattgtcttactactgaagaagaatgctgataaatttattgagagtccctagcattcttcaagttgtaatattaaataattgatgttgctagacattttagtttctccagagaggacactttgttgccaggagagctgtgcattttgagaaagacctaaggacacactccaaggaatatgtataaattataaccataattatgttctgtcttcagagcagagatacagagtggttttgatatattattcacagttgcaatcagaggaaactgagtcataagaaatttaattaacatttttgatggcatggagttaatttggatggtaaatgtagatgaacttgtaaaaaactactttgcataatgtactaaagccattaaattttcataaagagatctctaatcctagttcaagaatccatatcaatgctataggataatttgagacacataatgtctttatttaatttatttttattaaaatgacttgcttttatacttcagactctgctttaattatcacattttatgcctcttattcagacatataaaaaatgtagttttctttttaaatttatgtatgtatttaataaacaactcatgttatttgtagaataattttaaaaaatgtgtatagtaagaaaaaggcatccacaatgtcagtacttcaaagtaaccctatggagtatatttatgccaatgttttttacacatagatacatacatatttagggtttttaaaattttgttttgattttttgagaaattagatcatgtaacacatatcaatttgtagcattttttcttttaacactatattatgaattttattaggtaactatatatatacacatatttatttatttatatgattatttaatggctgtgtgtttcattcacatattttctgactatatattaatattttctttagacaagttatttgcacatgtatattatattaccacatgatattagtatattatattacctcatagcctttaaaaaagtgccaaaatgaggggaagcatggatcagccttgtttgggagaataatgccatcaataatgaccaggcccaatatttgaattcaataacaactgtcaatcatgcccagtagattaacactcctaatacattttttttttccttttagattttactagctggggaagattttattttcttcctttattcaataaactcttacctattcttcaagaccaatatcaaatgtccatttctgtgacccaacttcatttctcctggggcattagttattcctttttctatacatttaaattcattaacaccctccattacagactttattggcctaccttgttaatttcttccacaaggttatttgttcccttaataggggaagcatgtgttattcattgttgtattcttaaaacccctacagtgtctggcatagagcagtaatatgtttatgaaggccaagatgcaagatgctctggcatttaaggggctggtattcagtcattaaacatcaatatatatatatatttttttttttgagacagagtctctctctgttacccgggctggagtgctggagtgaagtggtgcaatctcggctcacgacaacctccacctcccaggttcaagagattctcctgcctcagtctcctgaggagctgggattacaagcacccaccatcgcaagtggttaatttttgtatttttagttcagacagggtttcaccatgttgtccgggctagtctccaactcttgacctcaggtaattcacccatctcagcctcccaaagtgcacaaatatacttttgtgtgtgattacaatattaaaatacctccattttctgtagtaagctgcagctgttcgaagctctcaagtgctcaccttttcttttctctcagaacttccatatgctccaggaactaaatgtttaatatctgaaatattaaaaaggtctttaggaactacctgctccagcatgcacataccgtaatctgttctcatggtctgtgactcttcaaggcgaataattttaatattatttttcctcatagatacatcacattgcatttcctgttggaccattattacattgactaacttaggatattatcaatattcagagctatgagaagatacatccagggaggtttgttgtatatgtggtgatggtttgcttttttcttttttttttttaatttcctacacttccagaaaactcacaaaagtcattaaaaaataaaggcaccttctatttattttcatgtcaattactgtacagtaattctgttccttctatgtctacagaatactgagaaaattttacaaaagttacctaaccttttgtaatctactttctattacgagagcaaatggagtgtaagacgagctgagttacttgctccttttgaactcctgaactgaatagggtagtgcacgagtaacttgtgacacgagtaacagcagcctgtttaccattagctaagaatcattttagagcactgaacacctttgagattcttttctcatttagactttcaaaatttctactcttgattaacataacacaacccaaagacattgcttattattccttgacactgaaaataattttgcgaatttgttgtgtatacaaacaagtttttctaatcttacaaaacatgtttaactacattgctgattagctttagttgagtggagtttttataacatggttgtagctattctggtatacgatgactttcaaaacagtaaaatgcaagtatggtgttggtgtaataaaatttttccactaatacatttgaaatctgaatcgtctatattttaaacctatatagtgagctttattctgccttaaaaattagagggaaacaaaattaaaaatttttggaatacattttaatcccattttttaaattatctgaagattttcaaaatcacttatttatgtaaggttgctagtgaagttatacatggctacctgtgtttattaataacttgtatttttccaaatctagttttgcccctgttactacttctagaggatttagaatgactgcagggagaagagaaatggaaaatagtatgaggtttcagagtatgataagggaaacagagtggggagaattagaaggaaagtcttgtaactcaaactcccataccatccttccaaatcagttaaattcttctcctaggctagattccttcacaaccctctctgattctttcagagccagaactattatcttagagcttgactcattttcctctaagatgatttatcttgacaaaaatctcatcctctagtaatcatccctagagagactccagtagatgaagaaacatttggaccacggatctttctcaggtggagcttttgattatggaatgtggttgaaatgatacttatacctcactttttaacaatacattcctgaatattagtgtttcaacattactggtagaaaatcctggaaaacagagtattgcgttttgctcaatgaaggaggtaaaaatatgccacctgctatagcaaataactatgtattatagattttaagacagctagaagtttttgcatgttgtcaccacaaagaaatgacaaatgttgaaagtgatgaatacaataattacccaaatttgatcattataccatgtatacatgcattaaaacattacattataacagtgcagccatcaaaaagaatgaaataatgtcttttgcagcagcatggatggaattggtggacattatattaggtgaactaactcaaaagcagaaaatctaatatggcatgttctcactttatgtaggagctaaacatgggtccatgaggacattaagatggagataatagacactaggaactccaaaaatggggagtataggagagagtgaaggctgaaaaattatttattcagtaaaacattcaatattcaagtgacggatacactggtagcccaatcccaccattatacaatatacccatgaaacaaacatgcacatttacccctgaatctaaattaataaataaaatttaatatctctttgaattatacaacatgtatttctgaaaaaaagaaatactacagtgtaccatctaaatatgtacaattattatgtgtcaattataaacttaaaaatttaatttaaaaaaatgccaccttggttattgtttgtttcaattaaaggaacttgaaaaacaacaggtacaagaggatcactctgacctttgctctgtgtcttaaaagttaaagatgaaattcttatgtaaaatgtatccttcctatactagaaaaaaggcaatggtcttatcatcaaagatggaaaggtgaggccgagagaattctgtacaacagcaaaccttgttaaactaacccttatctgtccaagtaaagactctcacctaagcccctttgtcttatcaaattctcagtttaccattctttgtttcatcagtatacaggtaactgactctaactgcttctttggggttttcatttctttataagggtgccgatgccacatgaaacttacatgaagtaaatttctacgccttcctcttgtgaatctgttttacatcaatttaattatcagacctagccaagaccctgagaggatacaggtagagtcttgctgcccctacactcatgtattgtaattactgctttattatttctagaaaatctttgattgctggttatgtcttcttaactccagctggcttattcaaaccagttttcttcattttgggtgactatgcatttaagatattagggcattagaaaacaaataaaaattatttcatatccacgaatgttaagtattcagagctaagaaagagacagtatttctggctgccagagatattaaaatctctagaaagtggtatgtccctttcactgctacagccaccgccatgagtatactcaggcttcagaagaggctcgcctctagcatcctctgctgcggcaagaagaaggtctggttggatcccggtgagaccagtgaaatcgccaatgtcaactcacgtcagcagatccggaagctgataagagatgggctgatcatccttaagcctgtgcctgtccattcccaggctcaatgctggaaaaataccttggccggccgtaagggcaggcaacatgggcataggtaagcaaaagggtacagccaatgcccgaatgccagagaagatcacgtggatgaggagaatgaggattctgcgcctgctgctcagaagatactgtgaatctaagaagattgattgctacatgtatcacagcctgtacctgaaggtgaaggggaatgtgttcaaaaacaagtggattctcagggaacacagccacaagctaagatagacagggcccgcaagaagctcctggctgaccaggctgaggccagctggtctatgaccaagtgagcacgcaagtgctgtgaagagcgtctccaggccgagaagaaggagataatccagactttgtccaaggaggaagagatcaagaaataaaagctcccgcttagtctgtacacactggcctccatgattacacagatcagccattaaaataaaacaagcctttatctgcttaaaaaaaaaaagtggtacataatagtagtgactattaattctctatattctcctgtagtccacatgaagtaccaatgcactttatagaaataggctcgccgattttctaagtacaaacttggtttccctaagaaaagatgtactgcttatcaaacacacacacatctctataaattaaagatattacataattccactttgtgaggaagtcattacttgcattccaattattaaacactatctcccctcataggcaaggtgcaaattacattaatgctagtgtacagttttatacatataattacccaaagtattttgaatggatacagatggctttcagtttatcttcagattttctgtgtaatctttccccaaatcgccattcactcctatgaataaatacaattttgctgttaaatgtcttagttgagcgagcgttataaggaaatattgacatattttccctttatgattatacctgatgatttctacttgaaatataatatttttctgagaattggtgagacagaagaattcagacaacaaaattgtcatttctatagtctaaagttttgagcaaaaaaaaaattagaattgatgtttgaatttcctgctgtttttgcctgaggtgattctattttacagatgaacaatactgttcaaaatgtttgatagctggatcacaacttcaaagggataatcgaaaaatacctctttgtagtagctatactttaaagtctgttgttaacagccttcagtttaaattgctgtcttctggctatgtattctcagattgaaaatctacagagttacttcatttactcttgtgtaatacagtctgattactgataagcttctagtttcggtgactatttgtagattatattttctatctttttgcttaatgaagtatttttataagctgtatttttcatttgatcttaatggcctaaaaaagatcaaactttgtttttaatttgctttcaaaaatattcaaattagaacttgcatttctcagttcactgtgttggtgatgattatcagaatgaaatggtaaatacaagaaagtgcatcttttatggctggatacacccatcaacagaaacaaacacaaaaaaaatgctgctcttttttcaaataagctagagaaagcatctgtcttactataaacagtatacttcaccaaccatgtaagaatttatttttattgtcatgatttagctggttgaaagtggcttttaccagtctgcaagttactcactgttttgattaaggaggctttctaaagagacactgatggactgcagtagatagtaatttcctaaggtagaggatctatgactagtgcttccctcactatctttgcagtgcttagatgtcatcaacataaagacagttaagagaactgatgacctacaaaaaccctctcaatatttgtagtatagaaagactgagaatttgaaatctaggaacatgactcttttgttattatcaaagttaaatggaaagtagatctaatgacatgatggaaatagaataggaattttactcagcatgtggtaaaaagataattgaagaaaatatagttgtgttacaggaagaatgtagtaggtttaactcaaaagaattcttttatactcatgttaaattatagaaattttattgccactaattcaaaggttatgagttgaaccaattggatattcacataacaaagttatatattttaccaggcagataataatgacaatatacacattagggtatatttcactgaatgggtgaattacaatgtcagagtggtcttgtgggtaatgggacatttagctctattatgaagaaaagtcaaccggtatattttgatgattgcacaggaaaatataggaaatactaattctggcaatgagcaatactatactacaaggctacagttaccaacgcagcatggtactggtaccaaaacagatatataaaccaatggaacagaacagagacctcaaaaataacaccacacatctacacccatgagatcttcaacaaacctgaaaaaaaaaagcaataggaaaaggattccctattcaataaatggtgctgggaaactggctagccatattcaaaaaaatagaaactggcccccttccttacaccttatacaaaaattaactcaagatggattaaagatttaaatgaaaaacctaaagccctaaaaaccccagaataaaacctagtcaatactattcaggacataggcataggcaaagatttcatgactaaaacaccaaaagcaattgcaacaaaagccaagattgacaaatgagatctaattaaactaaagagcttctgcagagcaaaataaattatcatcagaatgaacaggcaacctacagaatcggagaaaatttttgcaatctatccatctgacaaagagctaatatccagtacctacaaggatcttaaacaaatttacaagaaaaaaaaaccctcaaaaagtgggcaaaggatatgaacagacacttttcaaaaggagaaatttatgcggccaacaaacatatgaaaaaaagctcatcgtcactggtcattagagaaatgcaaatcaaaaacacaatgagataacatctcacgccagttagaatggcaatctttaaaaagtcaggaaacaacagatgctggtgagaatgtggaaaaataggaactcttttacactgttggtggaagtgtaaattaattcaaccactgaggaagacagtatggcgattcctcaaggatctagaaccagaaataccatttgacccagcaatcccattactgggtatatacccaagggaatataaataattctactataaagacacatgcacacgtacgtttactctttacaataacaaagacttggaaacaatccaaatgcccatcaatgatagactggataaagaaaatatggcacatatataccatggaatacaatgcagccataaaaagaatgagttcatttcctttgcagggacatagatgaagctggaaaccaccattctcagcaaactgacacaggaacagaaaaccaaacaccacatgttctcactcctaagtgggagttgaacaatgagaacacatggacacagggagggaaacatcacacaccagggcctgtagcggggtggggggcaaggggagggagagcattaggacagatacctgatgtatgcgagattcaaaacctagaaaacaggttgataggtgcagcaaaccaccatggcacatgtatatgtatgtaacaaacctgcatgttctgcacatgtgtcccagaactcaaagtaaaataaaaaaataaaaaaaaactttaaaacttaagtgacataaaacaagaattattttgtctgtttgtaattctatggtacagtaactatgatgggctcagtatttgttttgtttttttctttttttgatttttgcctagggtcactcacataactctccacggctctactggttgatccaacgaaatgaacctggtctgttttgttctgctccttgtattctcattcacctgcaggttcaactgagattctcccaaggcagcactgcactccccaaggacagtgagttggtgcatggcagttctaaaacccagacaggcatccattgcaaggtcctcatattgcagggatagggggttctcctggataaggatcaagtcattatcctcagatgtggtttcttacatatctttcatggttcttggcaaatcatctggatctttgctctgttctctgatacactgtttcatatttataacaaatggactgtgtgttgtttattcaaagctaaaaagctttcttaaactgtgtccaactcatagaagcttgagcacccaaaaccttttccttttaatatttcttggtcccttttagtccaatttggaaaactcctttgtaatcactgagggcgtgatatggtttggctgtgtccccatccaaatctcaccttgaattgtaataatccccatgtgttaagggcagggccaggtggagataattgaatcgtgggggcagtttcccccatactgttcttgtgttgataaataagtctcatgagattgcatggttttataaatgggagttcccctgcacaagctctctttcctgccaccatgtaagacatgactttgctcctcctttgccttccaccatgattgtgaggcctccccagccatgtggatctgtgaatcaattaaacttctttcctttataaattacagtctggcatatgtctttattagcagcgtgagaacagactaatacagggcattttgtgtatcaggttataagttattccgtcagtcaaaagtaagatccacaattattttattagagactggttttctctaccttgtgtagtgtgtctgggtattgtgaaacaacattctaaatattctcagaaacctttcacctggctgaaactgtctactcagcaccaccttaaatggttttgaggtcttgataaagcttttcatagtaatacccagcttttggcctttattaaaaaaacctctttactatgaaaatttcttgcagtctgaagcgtctagaaataagaccaattttattttccaaactagcaaatattaaagccccccatatttattttctattctaccagaaaactgaaatttttctttttttagctcatcactcacttatagtactttattgtaaatagaagcacctagtgacatattccacattctgtctatatagttccttaagtgggttctatatgctaagttatcacagataatggttttgccaactgttcagtaatacataacacaaattgtcctttctccagccttcaacaagttcctttgccggccttcattgacaacctggatatcaatctagtctcggccagcagcatctatttgcctccaatcccaaagccaatgtcacaagttttagatttttgtcatggcaacactcatttcttggaaccaatttctgtatcacttatgtttctgagtaaaaaccacaccagttcttaatgtcttaatggtttaaagcaataaccgttttatttgctcatggttgttctggagagcaatttgtcctgggctcaacttgtccagggtggttcttttggttgtcttaccagcgatcatttttgtagctttagtgaaatggtggcttatatggaaggtggttggtctagaaggccatggttgggtcactgtgtctctgctgcatatgattttatgctcctgcaggctagtttgggtttgttcatatagcagcgttgtgttccaagacagcaaaaacagaaggtgcaagaattctaaacttggatattgcaaaacatcagttctgctacctccctctaatcaaaataagttacgctgtgatcccagattcaagcattgggaaaataaagcattaaataaaagagtggtaatatcccattataaaagggctgcatacagggataggagaaacttttgcaaacgtcttggcaagttacctaccatgagaagtaatttattcttcaagggtcattggtagggtatatgcaattggaagagatgggctagaagcatggatgtcagagagaaatgaatacaataattcagataaaatataaaaacatgctgaactgaggtcatgagaattttgaagagatgatagcatggatggtaacagtatgttaaagacaaaataacagaattaattgatgaacatggtaatggagggctatgagagtttccaagattggaaaagtgtttgaattgtgatcccagtgaaacaaatttaaatgtagtgggaaaataaagttttaagtgaagactttcaaactgatgtaggatataagaagcttaagatgtgctcagtcttacactgagccctgaatggctacttctttttagcactctcttcagaacacacagatgaataaaagaagaatatcacctaaaacctcagagtttttaagggactcatatgtgtaactgaataaaaataataaatgcattgttacaggggaagattgataaataggcacagaatcagtaaaaatatgttacagatttggagaaggttaagtagctaattatggacaagtataaattttatttgcactgtcatatatctgaatatgaaaaagtcacagattccacattaaaaggaatttttaattttgtgcaattcaaaattgtgtcagaaaattcttttaaaaagatctttaaaaattcggggtgtgtgtgtgtataaatattatatataattattgagatgattcacttctgtgtccccgcttaaatctcaccgtgaattataataaaccccatgtgtcaagggcaggatcgggtagaggctattgaatcatgggagtggtttgccccatgctgttctcgtgatagtgagtctcacaagatctgatgtttttataaccatctggcatttcccctgcacgcactcattctctctcctggcaccctgtgaaaaggtgccttctgctgtgattgtaagtttcctgaggcttccccagccatgtggaactgggagtcaattacacctcttttctttgtaaattaaccagtctcaggtatttcttcatagcagcataagaatggattaatacagtataaatatgctatataattatatatgattaatacagattaaataagctaaaaggttcataaactttcatatattttacaaagaaaaagaaaatttcataatttgtttactaaccagttagtaattctgtaagatactctactgtacatgtgcttcattatgacataagtctacattatcatacttgttaagcattatcattttttcaaggaaacagagaatgaacacatggacactagcttgtctagttcagtcagtgtgaaagctgaaattagaatctaagtgtgccttactaaacagcccgtgctatatccagtaaatcaaggtagcagtgtttctggatcatgcccatgatgccgctcttttaatattataaaaggtaacaatggggaaaagatatttgcatgtttgtaaccatagtctctacattaaatattcagtaagaattaggtgtagcaagggtagaacaaaaacaaatctactgaaatgtatattaaaggtgaagattagattcaagtttcagctcaaaacaatacacaggcacacacattggaagtatatcttggatgactttttttttttgagagtctcactctgtcatgcaggctggagtgcagtggtgcgatctcagctcactgcaacctctgcctcctggtttcaagtgattttcctgcctcagcctcccgagtagctgggattacaggcacttatcaccacacctggctaatttttgtatttttagtagagatggggttttgccatgttcacctggtctcgaactccttacctcagtgatccacccgcctcagcctctcaaaatgctgggattacaagcataagccactgcgcctggctggatgactttcatactattattttgtgaaaacatattataaggtttttgcaaacttatttctctttttccacacgattcttattatagcatgtaacttctggtaggaaggtaaaaattaaatgtggtctgactaataaactgataaatactttgaaaaatttttgttaaatagacaaaaaactttatagaaatccagccatctcagacttataaacaagcaaataaataaataaataaataagatgccagcaagaattactggagttgagccaaatgttccatgctagctttgacctcacaaagaagaattttaacatgagacaagatcagatgttaagttcagacattaaaattgttaaaagattaacagggttctaactgagctcagaaattctattactttaagtttacctttaattgtagttacttctaattttctcatgttataaagtgctattatgttccatgggagcgattgataacatgatctgtctttattaactttataattaaagaaagacactgcaccactggctctgctctacctaaacaaaccaacccattaatttaattgagattatgaactgtgcactcagatgacttggttctatttctttgcaagcagaggttgcatattttacctggaatcaagccacatagtctccactttgaataagcccgctatagatatctcttaaatgagaactcaccctaaggctatcattgatgccagctctttctcatccttttgccttcaatcttcagtcacttttgaagggtgagcaagtgatgatttggagtcataaagtctttctttatgactccaaataagagctatttgtagagtctatattctctgttatacttgatattatcagaatcagagttaagaaaataatgacatactcatatcaaagtgtaatggggtctatatgctgggcatggccatcagaatagagtagacaaactgactctctcatccaaaatcaattctggaaaaaccacaaaatctaaatgcagcaatttggattccagaagtggcaaaagttatgatgaatgctttgaaaatccctaagtcttcatagcctggcttccgtggggtgagaagaggtggggggattgaaatggggtgggtgacaatactctcagggaggggtcctgaagaggcaactgtgcaaaaataggctcaagcaaactttcaagtttcactcttgtacctcacccatagtgcattggaacaatgatacttgtatttcatactagagataaatgaaaaaagagcaggccacagacatgcaaggagtaaaatcaaggtagtttcattgtcctgctctggtgagaaaatatgaaaagtaatgcagcctatgccagtccctcgatcacttattcacctacactcccagccctcgtcttgtagggataagtattccatccctagaagaatacctcctttaaattctgattcttttaagagaatgattgctgggttgcctaaaatcctaacgttttgggaggccaaggaaggaagattgcttgaggctaggagttcgagatcagcctgagcaatattgtgagatactgtctacacacacacacacacacatacacacacattagcctggcaaggtggcatatgcacataatctcagtactcaggaggcttaggtgaggggaatacttgagcccaggagtttgatgcggcattgagttactattaatccactgcactccatactgaatgaaagagaaagactttgtctcttgcaaaacagagaaagagagagaaagagagagagagggcttaaccggtcagcaaatagaaaacacaacttccctgttcagatgtgtgcactgtcagctgtgagctgtgtcctctcccctcactctagacagtgctgatgcactcaaacctttcagaactaaattataaactgtagttgccacctggatattttgggctcctgtgtccaggcatcagcaggcacaagatgactcattgtcatcagagaggtcatgtaccctcaccaccaggaggcagggcagctgttacacaatgggaaagaaaggaatatctgtagaatccagaccggtgtggagtggactatacatggtgatgtgacacctggattttcagagaaggcctttcttaaggaagacagatttccaagacttcttcctttccagggaagtgcttcctgtcccactccagccagcacagcgagcagacagcatccagatgagagggtctgctacaggctccaagggccacctcattcaaggctatgtctcctcaggacaggctttatctggttgctgaacgcagtggggatatgaagttggaaacttctgtcatctcccaaccagagtaatgtgggacactctggttggcgatacttgctccgtgatccctaatgtactgatacaggcttgtctttgcacaatcctgcttcctccctccctttcacaggtgttcatggctaatcaacttttgcagcctgtattgctttctgtttttgctgttactggtggcgaatttgtacaggtctgcagcaacctcaactcttgcctcctcagaagaaagaatccaactgaggggaatgaggcagaagaagagattgaggcaagttttggagcaggagggaacattcattaaaaagctttagggcaggaatgaaaagaaagtaaagtaaatttggaagagggccgagtgggtgacttgagatcaagtgtggggtttaacctttctactcagggttaaacctgagtaacctgagtataaatatgttggcatattgcaggttcttgggtttctttcttctctgattcttcccttgcagtgggctgtctgcatgcacagttgcctgtgggcacttgggaggggagcatgcacagcatgtttactggagttgtatgcatgctcacttggcacgcacagtgtgtttcctggagctgtgagcatgttcacttaaggcgttcttcccttaccagccgaatggccctaggatgccctataccagttaaactctgccattttgcgtcttagtgcacatgtgtgagtccactcacccaggtcctgagatcttatcaagaggctgctgatcaccagcttcgggtgtttctgtttattaggagattgcctttccctggcactggctgtgacttagagagagagttaacaaccgcctgcccatcacctgatggttatctgacattcctggtgtggggcgggggggcagtcggagggggagccccctcctgctctgctcatgtctgtctagctacctactctaacagtgctgtaacacattatcagaagtttagtggtgtaaaatgacacaaatttattatcttttggtagtagaggtcagaaattcccaaggcaagttgttggcagaaacagaggccttcttgaggctgcgagggagaatcaggttccttgccttttccatcttctaaaggctacctgccttccatggcttatggccctccaacctcggccactatcatcaatatttctctcactctgatctttccacctctttcttaggaggatgcttgtggttacattgggcccacctggataatccagaatattcttcccatagcaacattcttaatttattcatatctacatggtgtgttgccatgttaggtatattcacaggtttctggaatgaggacatggtatctgtgggggaccattattctgtctactacacactccacacttcatctctgcatctacttctgggaaacagagcacatgccaacaatctaaaatgaaatatacacaaatgcatataaagtataatatattaacatataattagaatatatttactaagaagatttgtgaagaccctttggtcataggtacgtggaggatattcatatttgtataaaaattgctcagtttggcaagataattctgagaaggttacaggatatttacattgctgtgaccacagatgtattgcaaaacagaaaaactataagaaatcaaagataggttgggtgcggtggctcacgcctgtaatcccagcactttgggaggccgaggtgggtggatcacctgaggtcgggatttcaagatcagcctggccaacatggtgaaaccccgtctcttctaaaaaaaaaatgaaaaagaaaaacaaacaaacaaaaaaatcccacaaaaattagctgggcatggtggcatgagcctgtagtcccagctacttgggaagctgaggcaggagaatcgctggaacccgggaggcagaggttgcagtgaactgagattgtgccactgcactccagcctgggtgacagagtgagacttggtctcaaaaaaaaaaaagacatcaaagacacttatattatgatggacagtgttacaggcaagtgaaacaaatgagtaaatgagtttcaactggctgtattttgggatgttttgggacatctgggaagacattttgaagtttgagtgacagatatacagaaagcttacagggtaaaaggtcttgaagttttgagatgacaatatgtgttgagcctgcaagcttgaatgcttcttgggtccaggtagattattgattggctttgccattaaaatgaggtattcaatgtgtgaaggatgtatgctatatcacctcttctatctgataataagatactcttcaggacttaaaacaaacacagcatctaccgatgtgctgtctactactgtgtacattgtttggggtcgctagtattctgccagcctgtccctttgattacactccctgatacctgctgccacctagagtggaacctataaaagaggttggtgttagtgaatgaagagttgaagaacctaggggcattgattaattcgaatgtgggaactagacacttgggtagacacgtatttgggttatcatgacgaatttgaaagatatcatccccaaatctgggatcttctcacaattgcaaataataccaaaattggttagttattagagtcttcaattgtgaaaaggaagtaggaagaagagagacaagtcaaaatgcaaattaggtagagttaaaaggtgaaaactgaattgagatgaaataagaaagtatattttatataagattattttataatattttactttctttcattagctctaatttttattattttccatgtctatactttctttcttctttcctttaacctattaatatacattaaactttatttaacaggcaattccaagtacaaatggaagatcatgaggacaaagagaaaaaataaaaaggagaatggaaaccaaactgtatttattagagtatcactggcaaggctccttgcatttctcaagaataccctggcctctgctagcctaatacaaccaccttagtcttccaagtcccaaacattgtatgtcccggggtcagtgacaggacctacttttaagtacattgacatgggaatgaccattcatctctcttggggaaataactaaaagatattttattactggtattcctaggtgaaatgtggaataaaatatatcttatataaatatctaaatacatttagaaattatctttttaaaaaggaaatacataaaacagcatctcttcaagagaaaccaggctggacacagtggctcatgcctgtaatcccaacactttgggaggcagaaagggcagatcacctgaggtcaggagtttgagaccagcctggccaacatggtgaaaccacatctctactaaaaataaaaaaattagccaggcagagtggcagatgactgtattcccagctactcaggaggttgagacaagagaattgactgaaccctggaggccaaggttgcaatgagccaagatcacgccattgcactccagcctgggtgacaagtgtgaaactccatctcaaaaaaaaaaaaaaaaaaaaaaaaagagaaaggagagaaaccaatgattttctaataataaagaccttaaaaaggaaatatgaatacatacattcttatataaatacagataagtagatggcttaccagtaggcttatcaaattattcagttacctttgaacagatgagactccttactgtttttaaaatttattttttaaaagcgtaatgtgaattaaaagtagaaaactcaaattacaaaaagatactcatagttttttttaaagttgtgtcaataataacaaatatctttggggttcaactcaataaaaaaatttcacacaccagcagacacacacacaaagatattgagtacagggtgcactttaatcaaaatcagtgaacttgaaaaattgaaaaagctggaaagcatcatcatcatcatcaaagaaagtctcagcaaagaaataaaagatatgaagaagaatcgaatgaaaaatttaaaactgaaaaatataataactaaactaaaagtttaagtggatggactcagcagcagaatccaggaagaaaagaaaaaaaaaatcaatgaaatgaaagttagaatgatagaaattgcctactataaagaacagagagaaatggacactgaaaaaataaaaaccgaacatcagtgagtgggacaataaacgccctggacaaaaaaagatctaatatatatgtcatcataattctaggagaagacagagggtggagctgaaaagtatttgaataaataatggctgaaaacttccaacacttagcaatagacacatacccagagactgaagaagctaagcaacccagaacaggatacacccaagaaattcataccacaatacattataactaaaattctaaaaactaaaggtaacaaaaaaaaatcttgagagccaccagagaagaacaacagcttacttactgggaaaaaataaatttaaatgacagtgaattttttttttatcagaaaccatacataccagaaggaagtaacacagtactttttaaatactgaaagaaaataaacataaatccagaattctaaagtcagtgaagatactcactaggtataaagagttactaaagacattctcaaatgaaggacacataagacaatttgtcactagtaggcataccctaaaaaaatgacaaaaggacatttataaactgaaaggaaataatttacaaaaagatttttaaatcttcaggaagaaagaacacactaagcaaaaatatgagcttatatattatgtttttgttctctttcattttaaaatttaactactgaagcaaaaaatatgaaactgtctgatgggttttgaaaggtatgtagaggaaaattgttaagtaattagactataaataaagcagagtacatttaaaagaaggtaaagtttctacacttctttcaaactggtgaaataaacatgagtggaccgaaataagttacttatacataatgtaatatctagagcaaacagcaaaacaagctatacgaagaattacaatcaaacatattttaagttttaaaaaatgaaattttaggccgggcatggtggctcacaccttgaatccaagcactttgggaggccgaggctggtgatcatgaagtcaggagatcgagaccatcctggctaacatggtgaaaccaggtctctactaaaaatataaaaaattagccaggggtggtggcaggcgcctgtagtcccagctactcgggaggctgaggcaggagaatggtgtgtacctgggaagcagagcttgcagtgagccgagatcgcgctactgcactccagcctgggtgacagagcgagactctgtctcaaaaaaaaaaaaaaaaaaagtaattttaagtagtgttccagtaacctacaggcaggtaaaagaaatcagagaaatgaagcaaagaaacaaatgaaaaacatagtaaaatagcagaatagcagacttaagctctaacaaatcataattacatttctgttaatcgtcagttgttggcagagtgagttactacatacatcttctctatgcagtgcatgacaaactcacttcaaatataatgctataggcagattcaaagaaaaaaggtataaaaagatatatcatgataattttaatcaaagaaaaataagagtggctgctttaatagtagagaaaggaaacctcatcggaaaaaatttaatagagaaaggaaggggcattgggatggttaatttcatgtgtcaacttgactgggtcacaagattcccaaatatttggttaagcattatttctgggtgtatctgtgagggtgttcctggaagaaattagcatttaaataatagactgagtaaagcagattgccctcaccaatatgggtgggcagcatccaatcccttgagggccttgtcttagcccattttgtgttgtgataacacaatacctgagactgggtaattcataaagaaaagaggcctgtttagttctgcaggctgggaagctcaagggcatggcactgtcacctgggaaggtcctttgttttttatttttatttttatttatttatttatttttataaacgggtcttgctctgtcacccaggctggagtgcagtggtgtgcaatgatagcttaccacagccttgaattcctgggctcaagggatcctctttccttagcctcctgagtagctggaactacagtagctcatcaccatgcccagctaggcaagggcttttgtgctgtgtcattacatggcaggtcaaaggggaagtgggcacaggcaaatggggcaaacctgaggaagaaccttgatttctaatatcctgctcttggattaactaatatattactgtgagaaataatccagtctcagagagtgagaactcaagacctcaagaacaacaccaagctggccatataggtggagtcgtcacatcttgaatgcctcccattaggccccacctcttaaagattccagctcctgacattgctggattaggaaataagatttcaatatgagtttctgcagggacgctcaaaccataacaggcttgaataaaacaaaaagggtagacatttatgtaatgtatgtaaatttcctattggttctgtttctctggagaaccctaatacaggcattgtataataaaaaggattaaaacaaaaagaaaatatagtaatcctaactgtctatgtaccaaaccaaacaacaaagaaaacctgttaagcaaaaactgatagaactaaaagtaaaaacagacaaatccacatttatagtagacaacacaacattatatctcaacaattgatagaacaattagctataaaatcagaaaaatttaacagaattcatcaacaccatctaattaagatttagaatatacttcacccaaacatagctgaacatacagtctttccaagtgctaaaagtaattaagatagaccatatcttgtgcaataacacaagacttaacacacacttaacaacaacaacaaatcacgcatagtgtgttctccaaatacaatgaaatcaaactagagatcagtaagaaaaagataacatgaaaacttccaaacacttggaaactaaacaatgtgcttcttaatccatgagtcaagaaggaaggctcaaggaaattttaaaaaaaaagttaaattgagtgaaaatgaaaatgccacataccaaaatgtgtttggcacagcttaagtattactgataggaaaattaatagctctaaattcatattttagaaaagagaaaaagtatcaaatcaataatttaaactccccctaaaggacttaggaaatgaagagggaagtaaatctaaagcaagaataagaaagaaaataataaagataagagcaaaaaccaataaatcatataacaggaagataaaaagaataaaggaaacaaataactgattcttcgtaaagacaaatgtgtttgcagacctcttgcaagacttataaagaaatttaaagcgagagaaagcaaaattacaaacactggaaataaaacagagtgtattactaaggaacttttagatatcaaaagattgttgcatactagaaacaattttatagacatacatttgacaactttgacaaaatggatataatcctaaaaagatgaaagcaattgcaactcacctgacatgaaatagatggctggaataaccctgtaactattataaaatatatttgtaattaaataaggcaaataatgaaatctctaggcgcagatggagattcccttgcagttctaccaaatatttaaagtagaaataacaccaatttttaacaatctctttcataaatgagaagttatactttacaatttattttatgaatctattattaattttatgtcaaaatcagaaaaaagactgggctaaaagaaaatgatatatgtgaaaatataaatatataaatatgaatatgaaaactgaaaactctaataaaatgttggcaaatatatttcagaaatataaagaaaggattatacactacaatcaagtgaaatttatttctatgattccaacttatttaatatttgaaaatgaatcaatataatctaccatattaacagactaaagaaaaagaaaacacatgatcatatcaactgatgcagaaaagcatttgccaaaattcaactgcctttcatgaataaaacaacaccaacgacaacaaaaaacacctctcagagaacaagaatagaaaggaagttccttaccttgacccaaaatattaaaaatctgcagccaacatcattcttaatggtgatactaaacactttttccttatgctggggagcaagtcaaggatgtcaccccttatcacttattcaaaataatgttggaagttctagccagtggaataaggcaaaaaaaaaaaaaaaatagaaataaacgacattttactaggaaaggaaggaattaaactttctctatttgcagataacatgatcttatacatagaaaatagcaaataatcatccttcacccccccaaaaaaaagaaaaattgactgctagagtctgagttagcaagctcataggataccacataagcatacaaatatcaactgtatttttatatctaataatgaatttgtgcatgccaaaattaaaaatacagtgtgattaaaatttctcaataaatgaaggaaactcaaagtactgataaaggaaatcaaagaagatatatatgaatggagaaacataccatgtttatcaattgaaaaactaaatacattaatgatgtcaattcttctcatatctaatacactatatatatatgtgtgtgtatagaagaatagaatctagagctaagcaaaaagctcttaaacttgacatcaaatatattacccataaagaaaaaaactgatgagttggatttcaataaaattactataaaagaacatttaaggaggatgaaaaggtagctatagtttgagcagaaaatatttacacatagcataactgacaaaggactactatctagaaaataaccgctaaaatcagagatataacccctaaaaacaagagcacgttggagaatacttcaggaacataagggttcacatttataatcatgtgactaccgtgtatcagtaagtctagcagacctagcactgttaacctggaaaataggttatcaaccttgaagaccgagggagggtacaggaataggttcagtacaccatacacagcttctttacgttttctgggcaagtgtgcagaaacatgccctagcaggcacaacactattaaatagcggaatacgtaataaacaatatcttaatgaggtaggttaggaagtatgatttggttaaattgtatatcccactcaattttacaaacatgttttcatttcctatttctgagtaacagatgactacaaatgcagaggttgaaaacaatgtaaattttttagctcaccgctctgtagctgggaggtcagattgactcagctgatttctctgctccaggtttcacgaggtcgtcattgagatgttaaccagctgggtacttgccaggagactctgggaagaatcagcttccaagctgatttaagttgttggcaggatccactgctttttagttgtcattctgaggtccctgtttccttgctggctgtgagctgggggcagcctttaactcctagagcctatgtctggtctgtcatgttgagccctgcttttcagagccagcaacagcttgctcagttcttctcgatcttggcatttctctagctaccttttaactggatatctctgagtcccgcctgagaaagttctctgtgtttaagggctcatgtggtcagaatgggccaggacaaccttatttcaaggccacaaccttaatttcttctacaaagttcattttgtcatggaaaggaacatattcaaatgttccagtgattatggcagaagcatttttgaggagcgggggcacacaattctcttaactgcagggtactgtgtgtatattgtgattttagaaaaacaatcttaaatactgagttcatcgaggttgcaacatacaagccatgatgcctttgaagtgttcatttaaccttactaagcctcagtttcctcattcataaaataaagatgttaatataaacttcatgagattactgtaaggagtgttaaaaattatacccaaaaatatgaaaaagagaaaatgatactttgaaatttttttaggaatttcctatacaaagatatgaaagtataaagacccatgaaaaacaaaggcaaacattttcaacctccattcataaaagatgaatgtttgattaaaaaagaggcaaaacaaattgatgagagaaaaacatggcagacatgaatagataaatggaaagaggttacagcagataatttcctctagactagaatctaacgagcaatataaatacagaaaaaatgttcaaccttacaaaagtaattaaataaatgcaaattaagaggaaatccaatttgttaaattaatgaaggcagattagaaagttgatttaaaaactcacagacatattgggaaaacatatttattattgtcatttatctgatgaaatggacatccccaaacaaatgctcatcatcaatttgtaacactcttattctcaaaatgaatttgagaaactttataaaaacccacaaatatttatatcctttagaataatagatatacttctaggaatcttaattaaataacataactctagtagagatttatctgtaaatactttaatcacagtgctacttataataataagagctaatatatattgagtgtttaatatggacaaggctctaatataaactttaatatatttatggtaaagactgttattgctcatcaagtattccatgtgcgcccctctgttatctagccttcaaaccatttacaccggggccatgttactgtttttgattaatagactgtggaaagttctgatgtgggttgcttctgggctagggccattataaaccagtgtgccttgtccattcctctttttcctggctgagaggaccttgaaagccatgtaaacacgtggtttgtgatgacatagaagcattacaaaatgaaaagagcctggtttcctgaagtaacagaggacattcccagtgaaacacgtcaaattcgatgtgaatgagaaataaatgtttcttttccagccaagccactgcaatttggatctgtattttattctactataatcttgccagacaggacaatatattaactcatacaatgtgtttaaaaaaaaaaaactctaaaaggtaggtacaattatttcttcaggttacattttaggaaattaagataaagtataggtaagacaaaaacggtcaagttcacagaaacagtggggaaactgtatccaaggagttagcttctgagtcaccttttctttttggagatggagtcttgctatgtcacccaggctggagtacagtggcgcgatctcactgagccacctttcttagctatcataacaaaaattacagaaaacaattctagctcaatgaatggaaaaatcaatatataatcaatgtctgatccatatgctagaatcttacgtgatcactagaataatgtctctaatttgcttttgatgaacttccaaaaaatgcttaaaccctaatttaattcagaagtcatatgtacactatataacattttgtaaactgtggctaaaaccagttccaggtctaataaaaaattatactattaaacctgaaactctcctgctacaaatacccagaaaagagaaagatgatatatagtaaacattattttaaatgagtagctgagcttgcaagagagaaaaatcaccaactactagaaataaagtaggagctgataatcagtaaagtaagaccataagaaggtgttgttgctgtcaggtagatggttagtcaccaagggcctttggatctaatgtccacacaaggaaaagggaagaggatatgggtctacaagtcaggcagtatgaactgacagatgccacctcagccaggacccaagggggtcctggaaccatgcacactgagggatgactgtaaactaaagagttggaccaaaagaaaaggaggataacggcttatttttgtttgatgtgataaactatatgatttctcaggttcaacaagctcaatgtagccttagcaagacaaaaactccatatcaacccctagataaaactcatcattacaaaacaccatgcaaaaaattaacagttaaggaagtgtaattgcactaacaaacttcttaataaggcaagctgaggaaattctggaataaaatgtctcaacatagaattctatgaacatatctaaactaaaattcaagtgaatggcttaaaaagggaaaaaagaaagataatttgccactcacagagcatcatcagggaactaccagttaaaataaacttcagaaatgggaaattgaagcaaaaaaaaaaaaaatagattgaattcaagaggtcaagaggtagttgtgagtaaagaaactgatatattttaggccagagctaatgactgtataaacaccatcatattaatagtgactcatttacagggcataaaaacatggagatataaaatactatagaacagcaacaggcaggaaatggggatgaaattatagatgttcaagtttataaaagcctttgcagttttttaaggaggatagaaatattatcagcaatagattttgttattaagttaattaccatttaggagcaggatattgaatgagataacaaagtgtagagtctgtgttttaagcgtttgtcattgtaagcagcaaactttcctatgggaaaatcagtgatgcacagagttgctacttgattgactcacagcttccccacaggaagttgagagtgaggcaggaactgttcctcttcattctctctcttccagcacattctctttcttccattccctctcttccagtccatgggatgggttctgagagcagtattagatggacgtactgccagttagagagaacactgctgtatcagaggaaagaggcctgggatattttcatgaaagcctgtcatgactgagggcacttctagttaaagaggaactataaacacttctggttaaacagagctattttttttttgtccttatctctcatgccctgatttgagggagtcaaatcaaagatggagaagaaggaggacactgaggaagggccgttgactgtaataaatcccaaccccattgttgattcctaagaccagttagtagagaatgataggattttatgtgagatcaaagttttaacttctagtggctgtagttttaacttttgaaagtgaattttcactctccaagagatctaaatgaaatttataagaaaattgtgggttctgcccaagatgacatctaaattgaagaaggtacacagtgagtttaaaggatcaacgagagaaacttttattattcatttgcacaagaagacacattcagtatctggattatccaatatatggaatactttgagttgaaatgattaaagggtaatctaatcattaattaacaaatcattaattaaacaaaataatatttagcaaattaagcaagtgctaaaggatacatgcaaactataattaatataaaagtttacacacaaaatgtttatatgtgtattatatatataattcttggtaatgttcaaaaatatattactatgtgtgctaaaagttcaactttaaaaatttattcatattgcttcttctgcatcattttattcagtagtagtgtttattagtggtagtagtgttatgaaggatgttaatattcacaaaaaacaagtaatagtaatttaatatatgtggtttcacagtacaaagaatattaaaattcttggtagtgatttaagtatagttctgcctaatgatattagaaaacttcttaattcttcctacatcatgagatgggctttgtagtctaatgcatttttaataagagaacagtgcattcatctatggcccattcctttatgcttaaaagaagatggcaatggttatatgccattaatttaagtatttatcaatggagtgaatgtaatttccctaaagtattacttatttacccttaacattgttaaaatcagtgttatatatatttataatcttattatccaatggaacttgttgataataaaacccactcatacaaatcacataaaatccaaaaggcatgttaagatgctggattttttgacatcaatcataaggcttgatatttttctaagttttaatatgttctggaaattaaattatcaaagtttttagatgacaatttcgtttactttcacattgtggaaattgatttctattcttacagctttaaaataagctcacattattgaggtaggttagatggagtagtgcctttcatatagtaatggtgaaatagaatcataaatgtttaaaatttgaaaggactaaaatatagtgcaattagtttatgtatagttgaattaatccaagaagaaacatcgatagcattatcaaagaaatcaaagaaaattaacaagtgttttcctcataaataacagttcttagttcttgcattggtaatgtatctgcaggaagtgaagattctggaagcgacatttaaatatataattttataatggggctgggcaatgagctttagccgaggtcaagcttccctgaaaattgaaatacatgaaattcttatgttcataaatttcagtatttatttactcctgacaatatgccacctcttagttcaaaagaaaaaaatacatatacatttaagagctaaggagtaaagttcaagaaagtacttaactttatatagccctttaaaatgcaaggtttttatgacttaagtgcaagctagtaaaaaaaatcataaattaatttttctttaccatggactcagagccgtatatgagagttgaaagtagtcataaaatgttctattggtttcgtactttccaaggtgctaaaggggaaaaaaatatattggtatgaatgtatgaattcaactgtggacttcagctgattcattgggcaggaaacagaacataagtacattcagataatatctaggacaagcaataaatctttgaaaaaatataatccaggaaactagtcactttttaatttttattcaaagtattaatttgattgatgttttcactgaattgacacatagcctatatttgtactgattgaaatactacattacagaagattctacctgcaggttttggtaaggggtaggctgataggaagtgttcttataagaatatgtgacaaagtacagctttacctacatggaattagtcctaagaaatatgaataatgttatccttatggatcagatgtttgctgtaattggtctaatgtattagtttggcattaattctagtcacacagtttggtcccatgtaaaatttcagaagcacgatttcttcttcctgctctatcttatgtttctctgtcattgccttaaacctaatatgtttttctcaaaaactaagtgtgaaattactgatttgcagaaaagaaataatacatacaattttgagtccaaatgctctaaaattcacatattttcaactctacaagtttacttctagaatatttgagtaagcatagagtcatagagatagccaaggttttgtttcatagttgtttttttttccctgtaatgtattatcagcaactaaaataattatttaaataaattatagtatattcagaaaatgggtttcaatcgggtacttcgcagcctttaaaaatgttatagaataacatctactaacatggaaatatattaatgatacttcataaactgttaataattaaacttattatgtaaatgaggatgaccttcaataggtgaatggataaagaaatatcaatacaatggtgtactactcagaaataaaaggaataagccattaattcataccatgacaaagataaatcttaaatatactttgctaaacgaaagaagccagaaccaaagctgatgtattatttgagtccatttaaacatcagttgggaaaaggcaagccagaacaaaaggctggaaaagtgcttgtgtggggatgcttttctccgtgtggtcctcccttttggttggtaaagaaggtgcctagtcactagttctaggaggatcaggactcatgaagaagacctttatcctttttttcagttggatccaaactctacttagtctagtccttgtttgaaccccaacttgcccatagatgtacaactgtgaaatgaatgctcctagtagcataaaattgggatttgtggttgatgaatccaacattattactgttaaggaacattactgtggcagtacggaaatgataaaatgtcttgccataaaaatatggttaaatattaaaacaaaatgtataaaaaacaaataaaaatgagaatatctttgtggaaaatgtaatatacagtgatgttttacctgtaatatacaaagagtgcctatatgtgaaaaataattgttaaattcttcaaaataggcaaagaacttaaacagattatataaggagtacacatctgtctataaagaaaaatattgcattagtacaaataatgcaaatattctaaatatgtacaaatgtatagaagaatttctatgaatacatatttttacataagtaacacaagtagatgtccaatatatcttttttacaacaacaacaaatatctgtacagtatatccaaataagattattaacagatgctacatccatttatctattaaataattagtaaaaagtacacatatataaagtttaaagatgattacctataatacaaatttaaattaaataggtttaaaataccacaaatatatatacacccatatatttacacttattctataagtatatatatattttaaatgacatatatttttaaagtcactatttttgaatgacacccgtacacacactagaagactagaaagaattggatctgaatataagaaattcttagtcactggttatcaaactttgtgtcgtaggctcttaaaaattattgagaatgtcaaaagcttttatttatgtcaaacctaactacttatatttattatattataaatttaagcagaaccttttgaaacacaagaatacacagacacactttcagtgatctgtcagaacaatggcgtacatttagcctctgcaatagaatgcacaggaaagaatgagagtgaaagagtcaaatatagtttcagtattattatgaaagcggtttctacctgactgcctgaaagtttctttgggaatcccaggtgctcctggactatactttgtgtccaaatgtatgatgtaggcagtcattattagtattaatttattattcatatcttaattttactttaaacataatttacatttttaatcatatgtaccttattttgaaatcagaaaaatggaaattattacaattaaaaagtcactagaaaaacagacctattgtacaaagattccagtcttacctttctcaagtctgcttactgatttttctcttatgtctctattctttccccttccctttgcccttcctttctcccttctgctctttgaccccaaactcatcttttcttcttagtttattaaataaaaaccaaactatattactatcaatatatttttactatatgcagttcatatagtctcgtgattggccaaagtctaatggttcccaataggtcctcaatctttaaggcccagtccaaaccttccacaatgaaggagaatcctctaagttttccagcacacaaagctttgcctctttttcatgtcactgtgagatcttcattcaatgcatctgttttactcttctcctccaagctgtatttaaaggaattaaaaacagcaaatcagtattatagttgattatattcctcagagtatcatttaactttctcaatatttacttggtatttactaaagtaaagttggcttatcaattgcttttgtatctggcaatgaacaactgtcaacacatggataaattatactgttaggcattcacactgactggtaggaaataaaaacttttattgtcattaaaatgaaaatgacaaaatatcctgcatatagtttttactgagatgtaaagtgaaagttgttaatgtggctgcaatatcaaaggtcactgaatagaactttcactaagaagtgtattgacaaattacaatgtataagaaggtatatggagaatttagaatttgagtgtagaaattttttcagcatttactttctcttctttgtcaagtgcagaagtccttcttatagttttgaagtaaaatattgtagtttttgctaataatagtggtagtttcatccacagatattttttcagaactatatagctccatagaattaacagaccaaccttgctagaagagatagggttaattcttatgaattcttatgtaaacaatgccgaatgttgtcattttctataaaaaccatatgctttaataacattttttttgaattattgggaactattgaaatgtaaagaataaagaataagattcatataagattttaatgaatattaactactatcaaaattttattgcatttattttatttatatatctctgtacataactacagagaaaaaagaaagagaaaaagagagagttgcagatataatctgaatatttttatataatgtctggaacataacatgacacaattacacaattttgacaagcaaaattacctaattttcttgtgataatttgatttcctctttaatgctacttgaatatttcctaagtgttacttgttcattcgtaatttttcttttgtaaatattttagtccttcattatgctgcttttatttttcaattaaggcatttgaaggaattcatattgaatagtgtggattatactttgaaccagcacaaagtggtcatgaatttgaattgacaaacaggcttgcagtgtacaataggcttcaatctgatactgtgtctaattagctttatggacagagagcactgtcatgtcatcagaaggcccagcagctgcccaagggtgcatcttcctgtgtctcctcacacacagtggacagagatggctcaagagcaagaaggcatttgtgtccctagccttggcttcctgccagtcttttataccaccctattcacgtatgtcaatggcttgtatgacagctcacagctaccacaggccaggtgttcgctaacaggaaacaagagacacacatcaaccctcatttattttaatacagaagtttcaaaggaaacagaactctatatcttttatgcaaaactgggtcagatcagacctgatgttatcccttactcttacatgtaattgggaactattttataggtttataaattatatttaactctctttagggtactttgatttgtaaatctcttttcatttctaattctatcagttattgttactagaatattcaaatctgatcataacaattgctaagttaacaaaattgattattccctcggtatggaccaggaagttgttctaaatatttacatgcattatttcacatacacgaatatacacacacatcattaaaatgtaagatgtatgaagtagataatttagtctattttattttcttttgtactttagagaattgtctatttgaagttagtttatagtacaattaaaataattatgaaataactgaaatttaaagcataaagacagggttaagaaaagtgaatctttaaataaaatataaaaaatataaaaatggataaaatatagtcaagtcatgcattatacatatatgtgtgtgcatatatacatttatctgtatgtatttgtgtgtatcttgctcctagttatatctatctatcatctatctatctatctatctatctatctatctatctatctatctatcatctgtctgtctgtctaatctcatctttatctataccctaagcccttcaacattctcttcttaggcaaccatttaaatatgcattgcatgtattttcatgtgaattttataatttctgtatttctgttttgtgtacctacatgttacatttttgcaaactatatcatgttgaataaatgtatcttttttctactccattcgctatgcacaatgtgctatggacctcaaaatctacgtagtaacatctaaactagtgttttcttcttgctatttgacattctgtttttaaccctactctctctatgataaacatctaggctggcacctattccttctatgtctgcaagtattttcctgggatataaacacagaatcaatgaatcaaagatgtgcctatacttaatgtgactaatcggtgccaaatacattcatatttgtaagtgagattttgctagtgtgtatgtctgtatgtgggtagaagtagaaatgtgtatgtatgtgtgtgtaccttgcaaatttcaaaattacttacctgatgaaattttgtcatttattgaagaggtcccaaccttttttggcaccagggaccagtttcgtggaagacaatttttctatagtcaggggtagaggggtcggaggaataattttgggatgaaactgttccacctcagattctcataaggagtgcacaaccaatatccctcacttctggagttcaaaatagggttcacgctcctataagaatctaagtccatcactgatctgacaggaggtggagcttaggtggtaatgctccctcacccgccagctgaccttctgctgtgcagcctgattcctaactcgggggttgacgtccctgctttattgtattctggattagtgaatataacatgtgaaataaatctcaggtaaaactatctcgcctaattcaagtatataattgagcattttatatttgcaaaatttctgagattctgaaatattgtaatttatagtaatattgcttccttaactcaaaaagttataccatatctataattaactgtttcttcatttataatccatgtttgaacttttacattttaatgaattaaaattttctttatatttaaacattattttcctttatatgtattatttctaatgcttactgttttctttttaatttctaatgtcattttaataaatttcttttaccttgctttttttgtttaatattgttaattaaccactttagatgtagttcagttcatttatttttataattcctgttaaagtggctattattttatgtaaaagagtattatttatcaaatatatgcataaaataaagcattcaatatatattatttcatatttataagtgcatgtttggttttattattatattaatttttctgtcagaaaaatgttaaattactcataataattatgtgcagatgtacccagaggagtcctggtttattacggttttctcagttatgattcttaataatgttaccttcaaattcaaaataacaacttggactatgaattattggtcattctaataaaaacaatttatatcaatctgttattttaaatatttgtttcatatataatgatgttatgaaacaatagtaaagataaaaatatctacactttgagaactatgtacgatgtactctttcaaatactttccatatatgaaataatttaatactcaaagcaaccctctgagaggttattaacctcaatacgtgaataactcaagtgagacaaagaattaagtaaactgccttaagataagaagataataagtagcatgttttctgctttcatgatttattttacagtttttaggtagttaattttatctccatctaagaaattttgattcttaatggatttgcttagatcatttaacttaatacttaaaaatacatttttttttcagcaacacattggactaagaggggccaagtcctcattccctcatagtgacatcaaattaacaaacagaaactggctaaaataattcttgtaagaattctgggaaaacaaaacaaaacaaaaaacttcaccaaccaaaggaatgcttattcaaaaaaaatgccaaattcaaaatagtatcaaatttcatggtgttttactggcccttgccccacccatttctgcacaacatggttttgagctggaggaggtggcattccagttgctagttccctcccttgagccaaagagagcaaaacaggtatgtcctgcaatgttctcacctgtctgggggctccctgaaggactggtctctatattcactaacttggatctcaggttgggatccaaggtttggaaaagcagtagggagactaattcccacagatacttggagcaagactttacaggcagagacatacaacagacctcctaagactccacggagaagctgggctaagattcctttggaagttacaacactgaaaatcgccatgtataaggaggcattttaaaaagtcacactcagacctaggcaagatgcatgctcagaaaaaaactggagaagaacttaagccttcatgctgggttaattccaaggtacagaacatatctggcctattagaaaagaactgctccagcacagagctggtctgcaagactgggaatgttgactgtttcttcaacccctcttccccaccaaaatcacaaggcatgtaaagaaacagaacaacatggccgattcaaagaaagaaaataaagtgacagaaatcatctctaaaactgcatgtattacctactagacaaaggcattaaaacaactctcttcaatatgctcaaagagcttaacaagaaatatggacttagaactataagaaatcaggaaaaaatattaacaaaatgagattatcaacaaaaagatagaaatgataagaattaaccaaacagaaattctggaactaaaaaatacaatatctgaattgaaaaattcagtgaagggtgtcagcagcagatttgagcaggcagaagaaataatcagcaaacctgaaaataggatctttgaaattatcaagtctgtggagaaaagagaaaaaagtgaaaaccctaagagacctatgggacagtattcaacagacaaaaatatacatcaccgagtctcagaaggagaatacagagagaaatacagtgcttattttaagaagtaacagaaagaaattttcaaatttgaggaaaaacaagaaatgcaaaccccaaaaactcaatatatttccagtgtaaaaaacccaaagaaactcacacagagacacactctaatcaaactgttgaaagttaaaagaaaatatagaatttttaaagaagcaagataaaaatgagtcatcttgtacaaggaatcctcaataagattataagcctattacttagatgaatattctataattttactatatgaggtacacaaaataatcaattcatacagacagaaaacagaacagaggttacagaatcccagaaggcagggtaatggagaattagaattgaaagtgtccagagttttagtgtggaatgacaaaaaagttctggagatggatggcggtgatgcttacacaacaatgtgaatgtaattaatgccactgaattgtgcacagaaaatggtccaaatggtacatttaatgttctgtatattgcaacataatttttaaaaacaaaaaatgtgtttagtttttaatcaaattgtttcatccttcatggtttatgtgctgacatgtgctaatgtgactttctgttgatacagatcgttctcttttcttttaaattttatagatttaaaaagtattcttactgttgtaagcttttacaacccaccttattttgttgttattgttgttttcagttttgttttgttttagactttcagcagcctgaagccatggtttttagtttctgtctcctgtgataagcggaaaagaggaatgagggctttactggcccaaccagaaagagaaactaagaatccatgactgtattctctcccttggacaccaaaggatgattttaaacaaaaaaacttttaaaagtatacttttgttatttgttttcaaatgtatttgtccatattaataaatatctgcctttttaatttacttttgttttggtaatacctagaattaactcatctctcacacctgtgtggtagctatataaaactgtgctacttacatatcctgctgaggggatctcatggtcctagttgctgctcgttcaaatccccaaccacatttctgctgcagctgtgctttctatgggttgttgccagccagtgactgagtatgatagggctactagttcaggatcttactgtgagaagtgagactcctctaaagaggaatgttagctcaagaattccccatcaggttgacaaagacttttacagaactgagctgcagtcagactcttcctgcttgatcacccttcctcccatctctccttcaaaggggtcagaccttcatgcagtctgaagtctctcctcactttcagctctctccattttatcttttatagatatttcccctaaagaatctcttgcatcttatctaatgtaggcatctgctgcttaagggatccaaactaaaacaacctgtctgtatcagtaggtatcacatttcccctaaaaattgatatattgtttgtccattcagagataggtaaacatttatgtatagtttacctttctttttttacataaatgactattttataccttgtgctttttattgaacacatacagaactttacttcattttaatacataaaggttttttcatttattttttaagttagtattttatcaccttaagaactcttataaaataaagataaagaacatagcagaattaaattacgttcttgattatattaacaataaagcttcagagagaaaactaagaaattgtaagtatattagttatagataaaaatgagaaaatgacgttgttatatagattaataattgatatttcaatatttacattctattatttcaatcatgaaaacattgtgaaacactattaactaattcattgctcacagatatttatattatatcacagtttttcctattcttagagtcctaacttcttagttttctaatgaccgttttcagattcatttaaaatcatatatgggtggcttattttttaagcattttatttttgaaaatataactttttaatagccttataaatatgtaactatttgatcggctgcgtaatcactgagacactggcttttcccctcaaaatgctatagcggctcacttatcttctttccccttgacatggcattgtctgagattcatgaaatccattaaacctctcctagaatttcaattcaggtttagaaaaaagaacaatctgattgtcccaatttttttgttgttgtgttagagaattagacatctgtcaactcatctgataacaggttacccttggtaacatgatggctcacgcctggtacaaaagttaatcatctaacaatgatcccttcagtaggtgacctagttagaaagttcccttagaagagcttctgggtatgtagacaacagcattgaaattgaacaaaaagcagactcatgggaatctctaaaggaaggctgtcactctgatacttatcacaaatttgtcacagtcatttgacaatagacagtttaaaataatttttcaaatatcctgagtataactctaattgcgtagaaaagaagcaaatctgaaagaaatagcagtgacctgttctctgagcttgattgtttgcctaggctattacctgaaatggaaaactagagaggacgtgatcaatagcaaagcactacccctggcaagtcttcatggtcttgttatcactggaccgtgcctggattacttaggaatataagactttgaaaggagagaatttctttcttttgcaaacacagagctgaaatcctcacagacataacagcgagaataattccacaaataaaatcaaaatttcttacctattgctacttttaaaaattacagttttacctcacatatcaaaaaataacaacaaaaatcaagacagtgaattcattatgtctatgttctttcataaaataatatatagttttttttcctgagtgggtgtatgggagaaagttagaaaatattaacttgatatggtcagatatccaacaatataaatttatttgaaagctgtgatgaataattttaataactgaagattaaaacaaataaagcaatttgataattctttaaaagttattccccacaattgatagaatttaaaatgaaattttattttatgtaattcaaataataaataataaaatttgattttaaggcaactatttttcatacaacatagaagaatgaagagttagcattttaaaagaagcacaaatatttacaatattattcataaataatgccaatatttgaagaaaacaataagatcatcttttttcctggtgacagcttcttaaaacattttaatattctgagttttcaactggatctgctgctgagattcatctttgccattggtatttccattccttacaaacaaagaaaaatcctttaatcttatatctgcactatatcgattgtcactgtaaatgacattgtcaaaacagcatgtattgattgctcatgggatgtacgttattatattaataataaaaattaccacctctatcaatggtggctatagccttatgtaagaaaagaaagtacaatgtctacatctcctttccaatgtcaccaggattcccctttttggtcaattaaaaggacatcccctagtcattctctatcaaatacctcgtttctttccttaacagaaccttcatggtttattaagtgttttatttaattgctggttttcttgctagtgataagagattgttttacctttgtatagttcttgatagtataatttctaacctaagtcataaggtcatagaattctagaaataaactatattaaataaacaagatgcattttatgaattgaaaaatagccactttgaggatctattatatcaacgataaagtgaaatcgaagattttgaaatattgcacattatagagcatggtctatagaatctagtgttagctagaatggcttatgtagcagatgaacaatgacacaaatgctttgctactattcccactgagaagtgaagtctaattcgttgccacttgaatctgggctggttttagtgacttgcttgacttatagaatgcagtggaagtgattttggaggacttctgaggcaaggtcattaaaagctgcaactttccctttgatgtcttagagcatcatcattgactgtctgtagttgacatttaagaagtctgactattgcagaagctatcttgaacagtttcagcctttccctctaaggcacaagacaaatgaatgattgcatcctggaccctccagatcagccattcattgagctcagtgccaccatgtgagctccactgatctcaagcagaagagaagaattaccaggccagacatgtacaaattcctgacgggcaaaatcatgagataaaataaaattaattattttagcaaatacgtttcagggtagcatgttacacatttagaaagaacaagaacaggattttgtacctgaaagtcggaagctgatataacaaaagttaaaatacgtggcaatgcctttggaccaggtggtaggtgaaggcaagaaggaactctaagaacttgttggtgaagagtggaaatacagatgagatattgtcatcgaaggcttaaaagaaggtgatgcttgttaaatagtggtagaagttttggcagcactgtcacctgcagtaatagagaaaatataaaatttgcctgatgaaatgatggattttctaagaaaactttcagaaagaatattgaaaatgtgcatgcatggacattttttaaaacgtttttaaaacatagttaaagatgaatggaagacattagatttgtatagttaattttttcaaaacaaaattagagaatatataaggtaggactcactgagtgttaaaaataatgttgtttttcacttccagtgtctccagatggcacgaacctctacaagtagaaagtggctccaagtctttgctattgtgaatagtgctgcaataaatatacatgtgcagttgtctttatagtagaatgatttataatcctttgggtatacagccagtaatgggattgctgggtcaaatggtatttctagttctagatccttgaggaatcgataggtacagcaaaccaccatggcacatgtatacctgtgtaacaaacctgcacgttctgcacatgtatcccagaacttaagtataataaaaaaaacaaccattttttaaaaagggcaagaatattagaaaaaagaaaaagaaagaaagtagactctgtgtaaagatgaacttgagtgtggttctaatattttcatgcttttcgttaagattttagaaagatttaatggtgtgcctcatataccaactcagccacactgacaggcttccaaaaatcataatatgtggtacctgccttggcaatatttagttcaaatggaataggtaccagtctcaacaaagattcacagccttggcttctgtctaatggacagaaccctgataaatttttaggcaggccacaaagtttttaagcactgtggactgaagacaaaaggggaagaagagaaagaggcagttcaaagtgaaaaaaatatatatcttcaatgcatgctaactttcctcagggaaaagcagattgacagaattccccagctgcaaaacatgaaccacttctaatagaaaaggagacacagaagagtatatatcaaggtaattcacatctgcatctatacagataaaagtctcaaccaacttccacttctgatgatttatatttcaaactcgtgttttaaaatatggacatgggtatttggggaactctcagagttaataatgcatgttatacaactatattaaataattgcattaccctttactgatacataaattagtaaactagagtgtgtaaaattttctgcaattcaccttggggtgaattggctggacatgcaacattgacgctggctgctttctccagtgacctcagtactgcaatttggtggctctttccaagtgtctgtggggctgtgggcattggagtgattctgtaataaaggatagtaggaaattccaaggcctcatattgtaagccagttcaaatagtagtactgacataaaatatataattaaataatattacataatattttaatgctttaaaaattagataatttacatttttctaaagtaatccaaaggtataattttctaaaaagctgttaataataaaagattgtttctttagttcactgtagaacttaagatgtcttttagtacgtgaataactcagaattctggattgaaactattatgtcatttgtgcttgctctagagagaagtcactattgcttcaccactttaaatctcaggagaataatgacaacttctgtatggtgtttttttaacttactttattcgtctataaaaacacagttttactgccttcttcctctgattctgatcttaatgaactaaaatacaaagaaatataaatttgtttttgttttaaaaacaccacttataaacatattctctaataatcacatatatctagaaagaatactcataagcaagaagtgactcatgtctcaaatattacaggattttaaacccaatttggctaattatttaaagctttctttattttcttctttataaaatgtatttgagaacatgcacgtaaaacagttattaaggggtgacgattgtatttatataaattgaattaccagctcttaaaacacaaatgctctcacttatgagtactttcatcgggttttgattgagaacccagtatgtgccaggcactgtattaagtcttagattccacttgcaataaaaaacaaaacaaaacaaaacaaaaaaacccacttatttgccttcatggaagtatctctctggtgggtgggaaagacagataatgggtaagaaaactagcaactaaatgaaacacttgtaaagcatggacagtactgtgaaggaaatacataaagtctttgctagagaatcattatggtacatcctttagagtgaccgaaaagaggaaggaggcctggtgacatttaaaaggatacctaggaaggtaaggaaaatggccagcaagagacagacagagagagagagagagagagaaagagagaaccagacagacctagggaatatgagggaataggtatttcagcaaggggacaataattgaaaggctctgagttcaagagagaaggccagtatgatctggagaagaagtcaagggggaaaatatgatttttgctgcatagatcattttttttccatgacgaaaatattggatcgtggagggaaaacatcgagcactaaatagaaaacattattataatctagttgattgttttgggcaactcgtaaaagggttacagcaacagagaggaagaaaaatgaagatacttgagatatatcttggttataaaaccaatacgaatttttcatagggatcagatgttggggttgaggaacagcgagaatgcaagatgattttaggtttctggcttgcaattgagttgaaggtatgtcaatttatgagaagaagaagattggtagagtaaaaaaaaaatatcaagaagacaattgttatggactgaattgtatttatgcccaaattgatatgttgaaaccttaattacaagtatcttaggatatgactgtatttagagctatggcccttaaagaggtaactaaattaatatgagatctttagggtgggccccaatccactctgactggactccttaaaagaagaggagataagacgtggagacaccatgggtgtgtgcacacagacagatgaccatatgaagaggcagccagagggaagccatcctcaggccaagaagagaggccccggagaaaaccaaccacaccagcaccttgaacatagacttgcagtctccagaactgggggaaaatatatttttgttatatatatacaaatatatttttgttacacaatctgtagtattttgtgatggcagccttagaaaactaatataacaatcagtagtttggtttggaaatgttactttcaagaacttacaggaccttggtgtgtagatgctgagtaggctgttggatttgcaacacagggaaggagcatcactggactgatcagtaatttttggaatttccagtatgtagatgatatttaaagcaattgacatggatacattatgaatagagagactgtacagagaaatagtaagaaagcccagtaacaagcttctaaaattgtcaattttaatgaattcatgcattgcattggcataaattgggggaaaatatgtaatccaaaattgagtttaaaactgaatataatattatttaaattttttttaaattactgttcctttcctcagactaaggttccacattatacatatttcttattttttgcaaactaaaaatctttaatttataatttacaatgttttcttcctttgaaatcttcattttaaatatatcttccacacaaaatcctgttttctaaaatacgcttttctaatcttaacagagaaaatgtcactcttacttaattaaatatgttctcttaagccaatgaattcaaggggattatataaatatttcatttaaaataaattcccaaagatgcacttatatgatttagtaaaaattatattcaatttttattttgaggtaacctggaagatatatatgcatattcatgaataacaaattactcagctattcctatattaaacattgtgaacaataagaaaatatttactacattttttctgatctcaagtagtgcactgcagtttgtcaaacagtactaaaattcttaaagagaaaaaatcaattttaaagactaatgtcataatgtaacagttttgtagactgctactctgagtcatagcaggaagaggttgttcagtttttcaccaaatttctgacaacattttgggaagcaggttcactgtattctggttaccacttcagtccattgcatcttgggctgcaatctctactgctcatactagtatgatgagtttgaacatttacacaatgcttacagaaagctaagcaactttattactcacagatacgcagcaagggaaaatagaagcttaagatttatggcaagctggtcacccaaggctcaggcaaactgcccatggagaatggatggattctcatctctgtgtgccctatttcactgcagctgatggacctcggaaagcagcctgccttggattttacacctcagggtaaggtgaaatgttggactaaagcattgtaggacgtcttgttataggaaggactggaacagagcctggcctattttggccagttccagcttatcacaggatgtggtgtttccagcacattctgcaactattgtggaaaagtacaagtgggaaaggggaaataactgggtcagtccaagaggtgaagaattgttctggacatttatgtgagaaaatatggtaattaatatttacttaatccctactatattctaagcattagctttgagcactttcacactgatttcatactctgagaacttgttcttattgagcccattttctagtgtattggaacaaagaaggcttaaataaattactgatgttttttagctacatgtttgagcaaacctctgtctctaaggttcaagctcttatcgctgtaccctttgaatttgggcaactttgtaaggacctgtaaaagcacaaactttttagcaggtaattagctgaggaaaaagtcaaacatccaaagacacacagacccacacactggcttcacacacatgctcatattgactttgaaacatgattttatctgcattatattaatatgatgctagggtcacaaaaaaacttttatctatgaatgtcccacatatatagtctatgaaaatacaaaattcctcaagttaagcaatgcaattttttggtaaccttaaggaaactgccttcccaaattgcttttcaggcatctcattgtcctaagatttgtaatagaagcagaggctgtaaaagtctatttacttggaaaagcaaaatatttcagtcttggaatgcacacaactcagacttcaacttcaacctaagtcatctcaatgggaaatggcaggcaagacaatggtaatattctcaattgttgccaagctgtgtctgtttctcattctcactgaactcattcatctcattgtactggaatgggtttgtggttaccataatgcacgcatgggttattaacgtagttttcactgctaatgtttagtgagttttaacatagtaaataataaagagcaagaaaataagcacactgtattcattcatattcacagactgaaaagtaacagggttctagtattgaggattggataaagttcaatgactgtaataaagagagatacatctccccactgtttctttctatactgctgcaaaaacaaaatataccttgctgaatgacagtggcaatcgctttgatatcagtgctttcctactgtggagtttaaagacctaaaccattatattaaacaaaattgcaggtaatcttttcaaacattccatttgaaggtactgggaataattgatttacattcaagaatatgtaagagtgcaaattttataccaaagatgcacttttacatgtatagcacaaattcccaaaggacatactaatgtttttcatacttctgctagtaattatttaggatacatatcaataccaattattaatcacctaaagatcatcctgccaaccacacaattgtcacaaaatatactctagccaatttattccttcccaaaacacatgacttaatatagatactaatatcaatgaacatataaaggcaatttaaacactaaaattaaacgttaaattaatacgcagagagcttagtggaaatagatggtgagcacttaaaggaccatttctccttctgttagtgtaatagcattgttactgaatacagaaagaggatcttaaattgacctctagtttttatttgtatttataaaataaaagcttaaatctatcacactgctaaataactgcttttcaaaaccggagacagcactttacattttattcatttcacaccaactgaatatgataatacctctcattatttgaggttaagagagcttgaacattcccaagaggttgtaattcaaatgtaggagcctgactttaaatggtatttacatatagtacttatttgaatacaatgaagttttttttttttaaattaggtacatacaaagcaatattgtttcccattgtttatttcacatttatttatagtatttagagtttttacaatacacttagtaggctttgctcatgagagtggctccttgagtactatagaaaagaacttagttgtagaatatgaaggataagacaatacagctacttactatttaaatcatcaaaatacataagaggtattgagttatactttaggttgatataactgcattttattttttgctttgtttttttcctgcctacagatttaaattgcttctattgcttcataccaatgatgtttcctcagaaacaaaatatgaacatcaaaactgaaaggtatttttaaaatttaatagaaaagtctgtatctagcaaaatggcaaataagatatcctgtgagattatagaaattcagttgttttctataaacagcacaactaaaatatctcacataataagcatcttttttttaaaaaattgcattgacaagcatcaagaaaactgtagtctagtaaaaaatcagctatagaaatttagtgaaacactggacacagatgttactctcagagcaaagactgaacattagagcttcagtttttatagcctcctctagcataaaggacaggaaataaggcctaggaattgtctgtggtgattaatttgatagatactctccataaatctgacactcaaatggcattatttttactaaaagtgaataagcctgagaaaaatcaaggcaaacagactgtcccaagtttggcacatctctaaaaatttgtagtcacaaactggcccttacaagggttttcattctaacctgcactatcttggtagtatccaaccttcaggtaagatagaaaattatttcagaaaaggccttccaaaattatgatgataatagttttttatctgttatacacacagttaagatttacaaaacacacaaggaaactaaaccctgagcaagatacagcagaaataattgtcagcaaaaccatatcagtgaagattttagatgctaaagttatcattcatataatataaataatttacataaatttaaataatttaatttagttttactattttaaacactttgacttttacatttaaatagattcataggaagttcaaaacataatggagaaagaacccataggataacattttaaataactatcataccatatcaaaaagaggaaattgatagtcatataatattataaactaaagtgcagacctcatatagattaaactaatttttcgtataccttcttttttggtgtataattctataaaattttatcacatatcaatatgtgtgatcaccatcacaatcaggatatggtattctctctctccaaagaaacatattcacgctacctctttcaggcataccgtgccctaaccttaaaccttgcatccactgatttgttcttaagcactcaaattttgtcattctgagaatgttatataaatggaatcataaatatgtaactttttgaggttaactgttttccagttagcatgttattaaaatgcatccaatttgagtgaatcaatagtgtattctccctttattatcattattattatttcctgagtagaattccatggtatggatgaaccacagattgtttatccatttacgcagagaagggcatctgagttgttctaattttttggcttctaaagttaaaaactaccatgaacgtttgtgtatagattattatgcgagcacatggtttcatttctctgggaaaaatgtgcagcattctgattgctaactcatatggtaagaatatgtttagttttttttttaaatgaaactgacaaactatttgacagagttggtgtatcatttacatccccaacaacaattcatgaaagacgcagttacctgttatcttcaccagtactttgtattgtcagcatttttcagtttagacattctaaagggtatatagtagtatgtcattataactttacgtagtatatcctaatggttaattatgtgagatcttttgcacatgcttctttgttttcacagatactcattaagtgtctgttcaagtattttgggcgtttcctaatcctattgtttattgtcttatggtttcattgtgagaattatttatacagtctggttacaagtcacttttcatgcatatgacttgcaaatacactatctaatctcatctggttgcatctcaattatcaaatatctcagaataaaaaacagcaagtatcattaatagtcatttagaaggtctaggtaaaaccagtttgggtatggttttcaaaagtttaaaaagagaatgattatatgacttacctatcaaaacttttgcaaatcagttgcttttaaaaaattggaaaaaggtttgatcatctagttaaacactatatccctaaaaataattctaatttttggtaggcaacattatgtgaactttgtctcataaaacagaaacaattgaaaagtttgctaatgttgctataacaaaacatcatctgtttgcatcaacttactttcaggtacagagttttctcattacttccataagaatgtagtacagaaatataattgatgatgatgccagtttaattctagcaccagataatattcataaatacatgaactatttgattttaaaatgtatatagagagatagtataagacccatattttagatataaatttcatttcacgcttgacattttcttaaaatttgtagtatacatgttttgactgattccatactaaaataattgaagttattcaattcagctctgaagaaatattttaacacctacagactcatgtccagaagaactaaaaacacaagtcaatattcatctataattttttagaataacattatggtatgataataaatagaagactttccagttgaaaatatattatatattagggtaataatctatgaaaatgtgcaattaaaacatgaatgtaagaagaaaaagtgacatagccaaaatttttagtttggtaaagaagagtttattcatgtatattttttcttcatggataacaatgagttatcaaattgccttggcatttagattccaatgggactatttcaaagagaaatataacaattttattttaaatgttaatatttataacaatataatgaagattgtatattttgcctaatatgagctcattaaaaaacctattgtatgaaaatgtagatattatcaaaaatatctgatcacacaacaagacaaggactaatacctgtcgtagttttttcccagcacaagaataatcccaggtaaaacaaagttacaaaatgccaccattaatttgatgactattagtaatgtaatgaatattagtaattcattgatttaatgaatatttataattagtaatattcataattaatattagtaatttaatcacttagtaataaatcaaccagttagtattaattcattactaatcagtaattaatgaatattagtaattcgtgccaaaacaaacattaataattagtaagtcatcaataaattaacccctagattttgttgatatgtcaacatatttataaattttcatttgcaaaatgttttcacttttggagtagcatactaataatatcaatgaaatctggaaaatacacccagaaaaatagacacaggcagaatttttataaaagaatatacagtgctgttgagaaaatttggtatgtgtggaattatagagagggcatataaaataaattttaaaataattaactcatacaaaataacacaaccacagtttgttcttcagttttttagaaaactgatttaagcaaacatctcaattcaataccttctggagcttccctttttaaaacttctcaaaaatgttactcttaaacagtttacttccatatgtttttaattgttaaaaaggagaaattatttgaatatttttgattctttgaaagtatatcttcagaaaaaatgtttgcacttacatatttcaaaatattttaggtaattttatattcatatactcaaattactgctgtatggaagggatgctgtatttatgtcatataatttaaaaaacaaattacagatatctaattatacttttgctgtttaatataatttgctcactttacttgtctagtttgtagaagtacaaatatgaatttatttttttctttagaaaaatacataatatattttattaaattattttcaattgtaagttaaattacttcaattttggtagactatattattcacatatattccttttatattataaatttttatattcctgtcttcagagataaaacatgtatcgtgaaacatttcatgatgaataagaaccatataaattaaatatttctgaagaaaatgacaatatgcaatgaatacaaattaaaattggagaaagttgaagtccattaaactctagtgatttcaagagcctgaagaataaaaatggcagatgctattactacttattttatttcaccccctcagaccctcggagaaaatgcactgctgtgaatgaacacatttctatcaaattaccaacgtcatttttcaattagaaaatactcttctaaaatttaaatgggatgaaaaaagagtctgaatagccaaagaaatcctaatcaaaaagaactaaagcctgtggcatcacattacctgacttcaaactatattacaaagctacagcaaccacgacaacatggtattagtgcaacaatagacacatagaaaaatagaacagaatggagaacccagaaataaagcagtgtatatacaactaactattcatcaataaagtcagcaaaaataagcaatggaggaagtactttctattcaataaatggtgctgggaaaactggctaatcataagcagacgaatgaaactggacttctatctctcaccagatacaaaatttaactcaagatggattaaagacttaaatgtaagatttcatatcctaaaaatcttagaggaaaacctaggaaatatccttctgtacatcagccttggcaaataatttatgaccaagtcctcaaaagcaattgcgacaaaaacaaaattgacaattgggacctaactgaactggagaacttcgcacagcaaaataatatgtcaacagaataaagagacgacctacagaatggaagaaaatatttgcaaactatgcatctgccaaaggactaatgtccagaatctataaggaacataaacaattcagtaagaaaaaaaacaataaccatattaaaaagtgggcaaaggacatgaacagacacttctcaaaagaagacatgcaagcgaccgacaaacataaaaaaattgctcaatatcactaatcatcagagcaatgcaaatcaaaatcacaatgagataccattttataccagcctgaatggctactactaaaaagtcaaaaaaacaacagatgctggtgaggctgcagagaaaagggaatgcttagacactgttggtgagactgtaaattatttcattcactatggaaagtagtttagagattactcatagaacttaacacagaactaccatttgactcagcaatcccatcactgggtaaatatacaaaaaaacaaaaacaaatttttctaccaaaaagacacatgcactcatgcattcatttctatactattcctaatggcaaagacatggaatcaacctaagttcccatcaatgtttaactggataaagaaaatgtagtacatataaactatggaagagtattcagccataaaaaagaatgaagtcatgtcctttgcagcaacatggatgcagctgaaggccattatcctaagcaaattaatgcagaagcagaaaaccaaatatcacatattctcacctataggtgggagctaaatcttgggtacacacagacataaagatgagaacaacagatactgggaaatccaaaaatagggagaaaggaagggaacaagggctgaaatacttcccattgggtactatgttaactatctgggtgataggatcgacagaagcccaaaactcagcatcacacaatatacccttggaaaaatcttgtacgttaatcccctgaaaccaaaataaaaatggaaatttcaaaataaaggaagaaaaaacacacagtgtgttgctttttacactaacaattttacacttaattttcaaaaatatttcttccagcaatactttgtccttgagaatattaaggtacgcccacccagctcttttttaagaaatacatgatacaaacaaaaggcaaacaaacgaacaccagaaaatttgcacgattcaatgaaaacatgtttattcattcactgtttattcattttactctcctgttctagaggagacaagtggtttgtttctttccctggagaaactcttggtatgagctttgaaatgtcaagtataattaagacaaagtgtactttttagctcgacaaaagaaatgtatctttcaaaataactgtctcttgaaggtagaaaacacagtctatctcagttgaaacagctcattgtgttaaatcacttgtcaacttcagcatggctccactgtggtatataatttagctgagtgtcccatcattgcccagcatggatggtactaccaatgggtactatcacagcacatttatgaagttctgagtattaaaaagaacccagatgccaactgctttaaaatgtaaacaatacgaatttgcttgtgacagaataaactcaagttgaaatagtaaatccacaagtaattgggacaaaatgtataaaaaaagtaaactaaatgttgtttggcatttcactgaaatttctcatttagctgtcatggatacatactatattttagatttgtgggagttcatttcttcggaaaacagccatgcatcacatttacataaaaaacgtacaattctttgtgatttcatggatgacttctcaaagcagcatgtatattaatgtaacacaaaaatatgagtaaattgtgttgtaggaaatttttcaaggaatatgtttatgctcagtgcctgactggatacaacattttaaaattttttattaaaataccttgagtaccttttatcaaacaggaaataaacagtgtatttttttgtaaataaatgtttttgcttttattatgtatctatatgaacagctaaggagaagtcccaacatgtatgacagaccttggccttagattcagggatacctcagttcccatacaaaaatagcagaaatagaccgtatgatctctaccaacggtaaatgatctcataatcataattactttcttagttataatatctataggtgctgtgggctttatgattaaataccagttttcaatcattattatttctaactctgttaaatggatattttttgaaattccatagcctggaatatatttttaaaactttgaaggacatttatattgaagaaatgtatatacttggcctagttcagcttgtttttgcagttttgaaaactctatgtcttttctcatgttcttgcctccattctatatgactttttccagttttcttttcctggacaagcttatctatttgtcaaggccaaagccaattgtgacctcataagtagagtattctctaatcaacagagaaataattaacagctccttcttctttgttttcaagtcacattactattctattggttatactccttattccattgaattatggtggattaaatatgtacctaaattgtgatctaattttcagtttgtcaaagccagagaacatatttatatatatttaaaatcactagtttctgataacaactaaagacagataaaatatttgagttaaattggattcaatttaaatgccatgcttggctattgtagtaagtccataacctatcataagtgtgaaagttaaagaagaccatctatattgcctttatgatattttgatgtgtcttcaataccaatgtccacatctcacaggtaaacaaataggtatggaaatcatatatcaagaatagtaatgatgttggagaaggatttcttaaaaaaaactgaatatgctatgaattatatctcttcttgacagaggaatgcatagcaaaaccccttagaacataaaaaaagtcaccagtctttatgtcataattttaaactttttagagaactatgtggcattaaaaaagttcaaaaagcactgaagagggagtcattcctccagtttttatcagagaatctaagccttaagggtatcatgcattatttccctctccctaccaccacctttatgacatgactgatattcacaattctgtactcataactaataagtggattcaggaccatggataggtataaaatgtgcacattgaaactgaagtattttttagtcatttatttggccatactgtagatgctaaagaatatgctatttgtcatgttctggctcatttatttttcataacaattttatgaaatgtgtttgttgataatcaaaatgagacttatagactttaatctcagcctttatatttgatctcaaatctgtgtaatttgaaaagcctgtgtatttaaaactactctactcctttcttaaatgaaacctattggtgactattctgtattgatgattgctgtactatgaacatgtagctttatcagggtgttaaaaaacaaaatattccatctgtcttcaaaagatcttcataaatagacattattaaaaagtggctaaagttttcagtccaaatcatatgttggactataatgtataaaaaagataatcaattaaataaagtcagaatattttttaaataacgtaactgatgaccatatcagatgtgttcattaatggagtcatttgatcagatgtggtccatttttttctcaggcttatttaggcataattacatatggtaaggagtccgccactggttaaaaacctatatgtgatttttaggcctgaccataggcagttgcaaaggcgttacctgggaaggcctcatggaggaagctgccctccccgcaccagactgagtgcaccgccagtgcattgaagtctctgaagggagctgcagtcaaggtctcagccccctggccaatcttctttcatacatttacactccgagccctggcaccttcattcctagtgatcctcaactgaagccttgggcagaggccttactcgggctcttctactgagacctcagcggggaggaagggaaaacctcagagtcatttttccccactttgacccagtatccaatgctgagtgacattaaaatgtgaactcagtgaaataaactactatttctgtagaataactacaaatatgtcttctattgtttacttaacagcaaataccaaaaaaaaatgtttttaatgaaataactctttaaaggccaacttaagattttaagaggtaattgtttaagaaaaggaaaaactgtcatttagcttatcaatttaaattcaggaatatttataaagtgcagtgaaagtaagagcctggaaatgcaaacattaatctattgaaactactcacaaaatgagattagacatgatcaattcatgtgatttttttagagtccattgttttgatgtttcttatactatatattaattttttctagaaaatagagtctgtaatgcaaataatttgcatcaaatatagctttagcaacaagaacaacaagaaccttaagatatgtaaataatttagggcatgatgtggatttccaagggaactgactgcaacaatgagattattattctggctacttattagaaaagcactcatctaaatactatcttttaaagaaactgccctagctcatcatgatgtattattaggaaacatacacttatgactggttattatagatttttgaaaaccaatttaacacgatatcttttcaacttttcaactctctcctttcagcttagagattctatttccagaaatatatcaaaaggaaataatttgaaaaagcatgtatagatatttaactatataaatattcaacatttattagaatgaaaattaagaaatattttgaaagttcccaaatagtgaaacaaacaaatatatatcatttctgtatgatgagatactttgaggatattagaaataatactgttagaaaacgtttaatgaaagacggatatttggtaaatatatgtaatactatatgaataaacaaaaataatatgttacaatgctgtatctttagtaatatctcactttgttttaaagtatttattaaaatagatgatacatcaaaatggtagcatcagttttctctacatcctgtgatttaagttcctgatatgtattctccaaatttcctatagttaaaatatattatattcatctttgaacaaatgaatgtctaaaatatgaacattgttagggttcatgcaataaaataaattcccacacatatcaatcaatctgtttgtaggtttgtgagagtctttttcttttcctttggaatcaagtaatgaatacaacaatttatttaaaattttgctttactaaatgcccacatttttctcacctatctattttctttttcttttttcttttctttttttttttttagttggagtctagctctgttatccaggctggagtgagtgcagtggcatgatctcggtccactgcaacctctgcctcctaggttcaagcaattctcatgcctcagcctaccaagtagctgggactacaggcacctgccatgacacccagctaatttttgtatttttagtaaagagagtgtttcaccattttggccaagctggtctcaaactcctgacctcagtgatccacccgcctcacagagtgctgggattacagggacgaacaaccacgtctggccctcatctatctagttccttttctaccttatatgataatacacagtctaattttctctttttgactatatcataatatgaatagtagccagagattgaatattttatcttttttatactaataatgtaaggattttaaaaagtgtattgtggtaaaacttcataagaacaacattcttctgtctttaaagctataatttttaatgatagtttaatgtaaagtttattgtttcagcattaaagttggaatgattttcaagcatacttttaattaagtatttaatttatttatatgtatcaatatattcactcttcatctctctcctaggacctttgctcaatcatgtcaagattgaagtatctaagtttaatatcttcttcctctgtatcttcttcttcaacatcattcacattctagactgcaagtataattaacataatattggtatctccaactgggtgttagttaatctctttgggccttgcttttctaactataaaattatagaataaattttgatgatttctatctatgttcaattgatgacaattcttgaatgggaaatgtacaaaattgacctgaacatcttatcataccagaaagaaaagagagtattaaatattaatagggtaggatcaaaaggtcattgaaatgaacactgaaaaagctccctctggccatagatgggaaaacgtgaatatcaataaggaaagttaccacaatgagttgaattcagaaatttgctaacattattctaaaaaaaatcatgtttggaaggtgttaggaatcaactcattatctagaaaactggcaaatgaaaggacatattttcatttcagtagcatcccagataacaaataaaaaatgaaaaaaaataagaatatcactttttcacacccattaatgaaaaacttatgatcaccaatgtccactaatactgagaaaaggaaaagacaaggcattataagcctttagatataagtactcagaagcagctatgcttgccctaatgatttgaatgtgaatctggccaagcttctagatttaactacaaacttacagtacatgaaggaaaatgtatagtatgtgaaataatattatggcaataattttaggaaaatgaagactatggagaatctacatggcaatcaaccagcttctccaagaattttcaaaataaaaaaagaattgcgaggcacagtggctcatgcctgtaatctcagcactttggaaggctgaaggagtttgataccagcctggctaaaaccgactccacgtccacaaaaaacggaaaaaaagtcagctgggcatgattgtgtgcgcctgtaatttcagcttctgaagaggctgataagagaggattgcttgagccccggagttccagggtgcagtgaactggtaatcatgtccctgcactacagcctgggatacaaagtgagaccctgtctcaaaaaaaaaaaaaaaaaaaaaagggtgagagagagagaagtgacacccaaataaaaatcactgaagaaatttaaaaactaattgaaaaataagaccatggctccagaatactcctggattaaatatcatataatatatgtagttgacatatataccattgttaacatccagtatgtcaaaaatgtccaactcataaaggggctatatttgtggaacatttggttgattttaaatgttagcatttaagtgaatttaaattatccttgaatagaatcatgttaacaaacattctaacaattggattagcctactatttgattatcatgaggtgatagaacatttaaagagtaaataaggtgacacaatgaatgcttcctgaatgctaggcatctcttggaaattatgtgtgtgttatgagtccaatatttttacattaaacactatcttcaagaaaaaaaatgaccatggaggactgacaaacaatataatagcaaataacattttaattctaatgattgtgctacacaagtgagacttacaaaggcatctcacttcaattcaatataaaacgcttcatttatatttttatgttaaatgtctctaacctataacctatatagaaccaaagaaacaattcgcattgcttttatttttttatttttatttttgtttttttttgagacagagtttcactcttgtcgtccagggtggagtgcaatggcgtgatctcaacactctgcaacctctgcctcccaggtttaagcaactttcctgcctcagcctcccgagtagcggggattacaggcatgcaccaccacgcctgattaatttttgtatctttagtagagatggggtttcaccatgttggccaggctggtctcaaactcctgaccttagttgatccgcctgtctcagcctcccaaagtgctgggattacaggtgtgagccactgcgcccggcctgcattgcttttataactcatttaatttccttagtatagaatttccaaacaggctccttataatctcccatgtattcacgtcttacataaatattcactgaatgaatttacctccattttatccaaatttgtttactgtttgctctcataaatccagtgcaggccactttctatccttttttttcctgaacattcattctatctagaatcccctttccttattcaaatcatgttgtcatcatagatgtattcagagagagccatactttctgaagttcatgaattacaaaatattattagagcaaccatgaatagaaatgcctagagtaggctcgttgatagatttctgtgctcttccaagtgcactttgaacatctatagaggacgaaggctgtggcttcatggcaattgatatattagctctgacattgagaaatgaccattatgttggcatggattatcaggaataactgtaagaaatgaacttactctggaataaaattcaaagatgatactaaacacatacacacagagtatgaagacaacagcaaaaacaagtgtgacagcatagagccagaaacatttaacaatgaaacaacctggttattcaaataaatgtgaatggtggcattgcaggataaagatttaatcatggcctgattggttaagaactgatggtcaatctctaactacagtttatttctacttgtgcattagttttgaatactttgtaactgtaataatgtgggtgacaacacaagtttctaaaatgaggttgtctaatatcaagacgtagctctataatttttcaacagagtgacttaagttttttatgttccttattgccttagcatgaaatctggaagtgctgagagtatgagtctcaaaattttgttgtaggattttgttgagataatctcctaaacattcttataacatatgaaaaaaaagaaggcttagaaataagtgagtgacttgtatggtatcctgcaactaacaaataatgcaaaaaaaaattatacgcaggttctatttgcaaaattttgtaaaataatttgagtaattgcttttatctacttatttattatttataggatgctatacatttagatacatttttatgaaactttattttagcttttcatttaaactttggttctaaattactatgtgcaaaattatgaaactatactgtttagattattcatgcttataaacacgtgtgtaagttttcatataaaacatgtttaaatgtaactatataaacatactcataaaaatagtgaacatattactttattttttcaaagtcatttataattgttaaatcttgtgatatcttctcactgttatttttcaatcatattttaaagtaaataatcaaaactggagtgtcattaataataacatgggaatttaaaattttgttttacttatggcttagttatagtttttacaacagacaaccatattagatttgggagacaaatttaagatgcaaatgtgggaaattagttcatgtaatatgaactttttaaacacaataatatcatataattctttcaattaattcccaaagaagttacatataatgatctcataccagcaaacattatacacattgttggaatatttgttttcaagaattttgatttttaatttaaaaaatgacaaaaatgatttttctaaaattatatatgtaatacacacatttatacccatgtaaaaacctacatatgtaaatatattacatatgtaatactatatatttatataagtataatatattagacatatatataatatatacacatataatgtattatgtatacatgtacatcatacatatatacattagaacacatatatgtattatgtacattatatgcataatacatatatacataatacattatatatgtaatgtatagacatatataacatgtatagatgctcacatatatgtatgtagccatgtaatatatgtaatatacgtatgtaggtatgtacataggtgtgaatatgtgtgtgtatatcctcatttcagatttctatttatcccaaacacccaaatgcaaatatctatattacttatctcttggatatttatcattagtttcagcagtcaatctggagggcctgcaaattcatacacaaacatttttcccagaaatcagagctgttattatatagctctgctctctgtttgatttcctatgttatgatttcagtggtgtttgactgacccacatgctactctaaacattccacaatccaatagatgataaaaagccaccagttacatttttattcattttagaaaggatgtggccccatttcagtgctcacagtgtttggctggaacacttgatctctttccagggcatgtttgtaaatgtgtgataactggaaagtagtcaggaaagctgaaaaccatatggttttgtctaactcctagatgtctaaaatctgtgggtctttgatttaggtattcagcattcacaaccataattgatgaatctcatgaaagctgtaaactcttcccttggaagcacacacacacatacacacaacttacaatataagtattgtcagtcttacttggcaattaggaaactaaagttatgataagttaattaaactgccaaaaatcacagagatttttatgtgaattttcaatccaggcttctctaatgctgaggccaattactatctatatgctagctgacacttcattttgactctgtcgaagcagtacggctcaggtgaacattccactctgagaaggttaaatctgataattttcatcagtcacatatttgaagtcataataataccattatttattttcaatgaattcagtaaattcaaacacaaaaattcccactggtctttttttacacatttttttacaggtcagacccgggttttattctgactgttgtatgcataaccacagtaccatttgtaacaactcagttaatttgtttaacttctttatggagcaagttgagttttgtatcatattcctttattaaatgaaaagattagaatactcgtccattgccagaaaagtagcagaatgatataatctataccaaagtgacacaagctttgaagtgtgacacatgtaagttggaatcccagcagtgtaacattcactgaagtattgtaaccccaagtgcttcagcttccatcacttctgcaacaaatgttaatttcgtactgtgtcattagcactgggtgaaccgctctagttggaaaagaaaacaagtcatgattcctgccctgaaataaaacttacattttttgtgtatatgaaagccaggatgtctgaaatctacttgggtggggtaatatcagaaaatacttgatggagacatgagtaatggaaactttggggcactcatcagaacttcaggaagggacagagaaatggaatcacagaatcacaggagtaacatgagagggaaacatgaatggaggagagaaggcctgtagtcttgaattgtctttgttcttgccttctcttagaagagctggttttaggtttcctgggtcccccaaagtattctatttcaataaagctattttttttagttatattgattgaaacctaactagaatactgtccttatggggtagggaaaaatagtttttaaaaccatcataaagaatagaaaattgttgtagaaagtgatgacactattactgtaagaattgggcttcatgtaaaattatgtaattaggttcggttaatgatatttatttagaaattacattataaaatacaaacattaggttctctctattatccatagatggtttatcttattttaaaaaatcattttccaatcaactaaaacatacccacctgttttacattcacttttttctttcatactaaagaaagaaaagatgctgtcagttaaactttgtcatatcatttgataataaaatacattttcatttcctctgttaaaaataaaaaaaatcaccatgaaataaataaaatatgacattttgatgaatgtatccattaaacgtatttctctaataagggtaatttgaattacaataaaatgacagaacctgtgacatgctataggctagaatctatgtatgtttaactggaaaactgcataatgctggatttgtctggaggtctccacactctgcaatgtggatgaacctaatttatacacgcagacacactctcacacacgcacactattcactcaatagctcacctgaattttattgcttgcaaaagagacttcccaaaaagagatatttaaactctctacctacttctatagttcctaataatgtagagactcatgacccatatcagaaagaaatataaagacacctagttttccagcactcagggtgttctttgtgattgctagagcatttccccaaagtctctaccttttctgcaccccctcaggatggaaaatgggaatctcctgagagggaaacgagaattgtggtcaggaagaagaaagtggcaggaagttgtgggacttgatggcatcctgggtagtgcagaactgattccaagtaaaacaacaaatttggagtagagtctgctactcatagtcacaactcatgctggaattaatattaaatttaaatattaagtaagtaagatataagacaacttggccataaagagattccacagctccaggtaggagttagcatatttccactgatggtccaactttgccgcaggcatacttctttaagatgagaaaccaataggagctgtgcatatcaactagtcaaaaatttacagaacacaaagatggatttgagccagcctgcaagtagagagtactgtcaaagactctgtgttaataaacatttacgataaatcttagctggccaaataaagcatcaaaagaaaaagtcaaacaacatgcgtcattggtatgtataaggcagaacaagataaaacagtatcataggaaatctcacaagtaaactctatttatagaaattacacgcttgaacagtccagcagacaattgtaatgcatttgttattcttttctttttttttcttttttggagtcggagtctcgctctgcaagctctgccccctgggttcacgccattctcctgcctcagcctccccagtagctggaactacaggtgcccgccaccatgcccggctaattttttgtatttttagtagagatggggtttcaccgtgttagccaggatggtcttgatctcctggcctcgtaatctgcccacctcggcctcccaaagtggcatttgttattcttaataatatgctagaaaatatagtctttaaaataatagttccccaaatcctgttgagaatatcaagttgagcagaaaattcagcaggatccaattaaaaggtaacagaacatgaggagaaaagctaaaagtaaaatgaaatagatgatctatagcaggattgcaaagaaatttagaacacagtgacaatatatttgtatactagaagcaataaaaggcagaatttatagtgtagaaatcaaattccaaaattcaggcatgatgaccatcagaggtgacgtgcaaatccactagtcgctacaaacacatagaaacactgattacaatggaatgtgtacctagtggaacttccaaaaagtgtgagaaactgtattttgaaacagaaacaaaaaagaaaaatcaaaaccagttagtgtgagctcatgccacctctatttgtgatggggtttgtatgtgtgaaattggacctggtgactgggaaaatgcatctgacaacccacatgaaaatggagacacattcttctagcagcaagaagtgtaggaggtggaactcagccctctgcacaaaccccagtgctttgaaatgctctcaggtatgtaaaaatgagcgagacttggtttgtctatccagaatgaaagattaggtgatttggaccagtctttttggtgaagtgcattagaaggttgaaaaatattattaaacattaatttgaagggatccatgagctaactaggaagtgaagaattgtgattcagagtccgaaaggggtttattcaaggatatgaacacggtgtcggtgaacattgttctccctaagcacattctgctaatttcaatgaacagtttagagaaagtaatcagtagtttggaaagggtaggggatttaagcaaagtctggaattaacaataagaggtttaaacaagaattgtgccatggtatgcataggagaattcagaggaaaagataatgaaatcagcatgcagcaagttgagtattatgtagtgcatttgatttgtgttttcaagatatccaagatgtttacctgtggtttttaatccatttggttattccttcaatgaatacacaaaaatgagtgataaaaagaaatacatacatccaaccaaatgaatggcttttgaaaacataacaaacataaaagagcttacttggcagtatttttcagttctgcatatattatatggacagtatgtagaattgtttttgtatgcttagtaattagtagtattactacctgataagaatcagttgcttccatctttggtttacattctaaaatctgttaacttaatctcttaatttttaatatttattgaaaaatacaaaaatatgtgcaaaataatatctatacctgctttcctggagaaattgataggcaatatgatgtgagcacatctctttctctttctgtctgcacacacacacacacacacacacacacacacacacacacacacaatcaagattatagacctactgagcagatggcctttggcttgcagaaaattggacctgggataactttctgaatttattttagactcaaatagtctttagtatgcacaaatcattaaagcataagtctggacctgtagagggtttctttcaatattttataggaaggattttgatctatgatttatcagtcaactgacagcactaaggggagagaggtttttttttttcccattaagaatcaattcttctggtagatttttatcttcattttcattccacccattgaaaaaaatctgctttgccatatgcctgtcaatttgagtgaccaggtacataagttgtataaaatgtaggaatttttaaactttgagaagcactgcaatattgcaaaatgcatttaaaaatggataaataaaaggtaccaagcaccttttatgttttcttaggtgcttttgaatgaaggaaatattaaacagaaatataattcacttatgtaaaggtcactattatgtgttatttctatgtacatcttgtcagctcatgggtagattaagaaacttggtagacaaatgcaattgcatatttctggggaatttgtagttgtaatctttacaattttttagtgtaatttattatgtcatattttgttatttattgcaagtcacactagtcagtattttttcatttctcagctatgtgtgactgaatttcaagtaaatttttcagtctgtttacatggactcgaaaagtaaatattatgggaagaaatgaccacgtttactaacaaattataacatgctattatttatttctacaaacatgcctgactacaaaagagccagcaggcatagaaaaccagtggcagctgctaggcttcaggtgaatatcagataatttggaaataattttcttagagtagcattattttctgttaagaaagcatagggtttggaagctctttattctctcaaactgctttccagaaagtgactaggttttcgtggtggttctattataatgatgaattggaattaaaacagtgctctaccactggtgtgcaaagagatcgcacacagtggcctttatttttatcagcgtcttcctattgtttaataaaagcacttcaaatgtcttttttcatgtgatgcatggaaatagttttactaagagtataacaaacatggcacttgtgtatatttctcaaacttatggagatgtctatatatagtttatttttagggaaaccactttaaaaaatttgtgtattgtaatcctaggtcattcttcctctcctcctcttcatgatcttaaaacagatttttttttctattctttactatactctgaatatgaatgtttcttttggaatctaaatgactaagtggtatgcattttatcattttattattaagatgattaattggtgtatacctacatactagctcaatatctttaacaaaactctactccagcttcagatagctctttttgcagatacatatgtttcaaagcactggcatagtgcatgtcactctcctttcctcccagggataccaaggtaaaaaagtgtattgttttctctaactttaaattgcaactttgtggcaaatccccatgttgatgattacatgtagtatacattgctgtatgcatttgtattaagagtgggaaatcttaatatttaatgtatatgaatggatgcctctttgtttccctcaggaaatactagttggctccaaattgagaaaactgtgcacaaacacatcctaatatagaagcagaataaaagttttaggaaaaagggtaatattttttaaattagactattttttggtctcctgatggacactcttttcatgtaatcatgggagtttggctcagctgaggttatctatctaaaaaataataataacagaaagaaaaacaactaggaaaatgagagaataaactctagatatgatacaagatgatttggtgacattcaatcaatggaaacacatttttaaaagcttcttaaaataaactcggcatttactttagatatttaaaatttcttactggtgaacatagtgcaaaatatttctattgggaattttaaaaaatcttctactaagaaaacacccatacacagctgggtgtgtaagagaggagtcagtgcatattaggctgactgtatttctgagataaaacctctaacagactgttatagtctgaaactttgtgtctatccaaaattcatatatggacacttaatcaccattttaatgtttttaggaagtggggccgagggcagagccctcatgagtgggattatgcccttatcaaagaggccctagagttctgcctttccctttccaccaccccaggacacatctaaaagttgccatctgtgaaccagaaagcagcctacatgccttcctgaattggtgttttttaccagcctgacaccactgaaaaaaaaatctggtcacgttattgaggacctaatctttcaatctttgaatcaccttatcatttaaatgttccccattgccttctaaacaaaatctaaatgcttttataatctgatcctgtctacatttacattctaatctctcacaaggcctatctttttgatgtgcatttaggtcttataactgcttacagaatacagaacatgtcatattttgggggactttcttgtctttttacctgttgttcttttgatttggactgcattcatccttatcccaattcttttgagttctattaagatatagtttagctgatattgccttctgaaagttttcctcaaataccaaatacacctgggttaggtgttttctgggatgctatagtaacgtgtacatccttgtttcatggtgtctgacactttattaattactttatgcctatctctatcattttaagtcccctgaagacaaaggaagtttttttttttttcttttgtgtttgtttaacagtgatcccaggaactaggaacatagtgaatgctgatgacttggtgcaaagaggaaggaaggaaagaggaagaaagggcaagggagacaggcagaaaggaagtactggaaataatgacagataatttcaagagagaagttaatcttttgtatgaaaaaaggacactaaggagcagaggtctttaagtcaggatgtaggaaagcaacttcagtcccacctcttattgctcatgttgggcaagtgctgcacatctatgagcctcagagtctcatttcacaagctggaataacaatgaatgttcatcctcctactccagggtgcaagggtcatatttgatgatatttgtgtatgtgcttcgtatttttgaaatacagagcaactgtatggttttattattttaaaatataacacattaaaaataaaaactaggtaagtgtaaatatttaacaggggcagcatatctgtaaaaattaaattttattttaagtttaatataatttaattatttcagagacagagtctaaaataggcacaattacagctcactacagcctcaaactcctggtcttaagctgtccttcttggcctcccaaagtgctggaattatagatgtgagccactgtgcccaatcaaagtgctggaattatagatatgaaccactgtgcccaatttttcttttcttttcctttcttttttttttttttttttttagatagagtatcgatctgtcacccacgttggagtgctgtggtacaatcttggctcactacaacctaccaggttcaagcaattgttgtgcctcagcctcctgagtacctgggattacaggcctgcaccactatgcccagataaatttttaaatttttcttagagacggggttttgctatgttgcctaggctggtctcaaactcctggtctcaagcagtcctcccaccttggcctcccaaagtgctgggattacaggcgtgaaccaccacatctggtttaaattttatttctatagtgataagaacactcaatgtgagatctatcgttataataaatttttaagtgtaccatgtggtatcgtcgactacaggtacaatgctatacagcagatctctagaacttactttccttacttaactgaatctttatgtccattgactagtagtaacccccaatttccccttctctccaactcttggagaccaacatgccactcatcaatattatgaaatttatatctcaaataggtggagtcatgtagtatttgattttctgcgactggattatttcactcggcataacatcctcaaggttcatgcatgttactgtatgttgaaggatgtcttttcttcaaagctgaatagtatttcattgtatgtatgtaacatttaaaaaatggtgaagtgattttctaaataagatcaatcctcaatgaaagtcataactattctgtaagtaaattttttttttgaaatcttaagcatgcaaccttaggcaatttctaaattgccaggaagaatgttttaataagaaggtacattcgattatatttactatgtctctccatttttgctcaattcaccattgctagtttattatctgggcttccaatactatgtcagaaatatattcaataattataagataaatgtatcagtcattagttacatcaacagaccaaaagcaggctcttttttcatgtacagttttgggcatcacaaatctaggctacattgaggctttatgtgtctagaacagtctatccattcaaactctccatatcaaatattgcattttttatttctgggactactaggatgcctataagttcaaaatggaaagccaatttgtgaattatcttaatattccaaggaataatttataacacatataatccacagtacacttaaaagctaacaattgatgttattacattgcatttttgtcaactttgctacagtaacaaatgaccagaaagtctccaagggtttatttcttgccctcgttacatatcagtggctctgttttgttccacatttctcttttattgtatgacctagtctggagaagctggcctccttttgggatacaaaattcttacagatttggaaaaaagagccagagagctgaaaggacatgataattttgaagagagtacatcatggctgttaaaattgccatgagaaactggcctattggtccttgtgctcacatatttatggcccaaataatttacatggccaagttcatgtcaaggagctgaagtgcattccttccacaggaaggcgatgcagttgcatggcaacacagcgatgtataatccacttacagggaagaggaaaacataatagtacaaagtataatgtccttcctctaaggcataaatacttacttctcttttttttccctatatgctaaatataaccaactcctccccaaggctaatataccaaaaatccaatccagtcctggcaatcatattcaaatatcagaatttattgataagtctctatattaggtacaaacctggctttttaaactcggtggtgcataaatacacacacatatacacacacacagactcacacacacgcacacgccaaaacctgcttcttacatactcaactgaaatcatagaatatcactattatgtcacagattcacaatcaacactgctattcaaaaatgagataaatgggcggcatacggtggtcaatggcttgtgataattctggaattctgttgaccagatgtttcaaggaacatgattatgatatgattttgcttcttggaaactccccagtgtgttctcagtggctcttggctccaccctcaggatagttcttcctttttttattgtacagttaaacttggtcatctctgaagaggccattggagaatgtcccttcactggtggctaaaccacttgtgtactggctgtaggcattgtggacatgagaaactgttttacatttcaaaaggttacgatttcttttagtccttgttgacggttttggcagtatagctctcttataactttgtttttcatcagttagattccagtcatttccaaatgattgagtcctttctaatttgagcgtacaaatggtcacactcacggtgcttttggaggcagcctcacctctctttgtctttctctctttaattaaagtgactttgcatttatcagacttccctgtgaaaacaaccttggtctgttttctctgacacattttgttcaactgaaatgatttactcatagctaccttaacctactcatatgtttaaacaaagaacaagatgtcaattattttaatttggtctctgctgtaggtcaattattaattaatcttaattgttcagagtacttacaaatgctagcacttattggttgcatattagaaacagttaagttggccagccctctaacacctttttttctggactgttgaatttctcttttactctttatggctcactagtgaaccctttcctgacctcatctttgttttgtcaagtccagttgataataacaaaaacacccttcacaaagttctatatcttacccctttttgccaaaagtcacattttaattaggtacgttatgtgacttgagagatattttagagaacagcgctgccagtttcattaatacataaaatttcatcaataaataaaacaggctgccatttttcatgctccaattatagtttacttgatgtccactacagagtcttgaagccaatatcatatacaatgttctttaaaaaaaatgtgacactctttcacttcacataaaatttctgaactgcttagcttttctgtgttaacagatcaccctaaaatatcacaagcttacaacaaatgcttttcctgtcatgttggctaaagttgttgacagctctgctcatgcctttttttgttttttcttccttttcaggatgttgcttcatattgtagcatgctgttttgttgcaaattaaaaacaaattaaaagaaaaacaaatcaacagagttggattaaacctaccgtcactctcaaagtttctgtttggaatcagcatactgtcacatcatttaccaaaaaacaaatcacctggccaagtcaatgactttgataacagtatgcttctcactcctcctgcaggaaggcactatagatccattgcaagcaactgaaatgtaatcctctcccagggaatggggtattagataattgggaatgagaattcataataacagatattctgataccgatttctcctttgacacactctgaaaaacctcactaactttccatagttttctggcccccaaatgtattctacagtttggggaattagctttgagtttgtccttgctgtcttcatttccacccacttgcatgtccttgcaaatttctatatataggttcaactccacctaattgttttagcctggtaatgtatcaggaatcaaatttgcagtttatatttatagtgtaagtcagttccagtcttctcagtgaaaattgagcctcctcttcaacccctggaagtttagtcaaggttctaattttctgcctagcacctattgtcagcgttcttccatgaggttggatcctattcttctccttcatgggtgtcttagttttctgcatcaacaagatacctagaatagtaatattattcaaatatatgccaagacccctggaacagtcctttcacagcccctctagcttaatcccattaaatttaattaatttagagaagggagatggactaagatcaggttttttattctccatggacattgcatttttttttttttgagatggagtctcgctgtgttgcccagcctggagtgcagtcaggcactcttggctcactgcaacctcaacctcccagggtcaagcgatcctcctgcctcaccctcccaagtagctgggattataagcacatgccaccacgcctggctaatttttgtatttttagtggagatggggtttcaccatgttggccaggctggtctcaaactcctaacgtcaagtgatccgcccacattggcctcccaaagtgctgggattaaaggtgtgagcctttgcacttgaccggacattgcaatttaaactctagttagtccataacggagcataagctttactctagaaccacaaactcccagttaattttgatccctattatctcatttagcatatgctttagccaaaactatataggttttgaaagtttgaggaagagcatgcatgtatttgatttgagtttgaacacctactgttgctgaaatactttataaaatattcagtttttaatcaaagactataaaaatgactctgtgatatatacacagtgaatacatatatttttctttttactaccgtcattttagggcactaatagtaatgcgtcacaattctgaacattcgtaagggaacctcaaagtggatgcgatacaaaattgtgtatttatgtgtgcatcggttgtaccccaagtggttttaataatgatttgacagctaacaagctatactttctagaactacacattagatgtttgtatatcatgaagctggtgagagtgtagtaatcgttcttgattttctataactaatgatttgacatttggaaatcatggttgcgggcgcctgtagtcccagctaatcggaggctgaggcaggagaatggcatgaacccggaaggcggagcttgcagtgagtccagatcacgccactgcactccagtctgggtgacagcgagactccgtctaagaaaaaaaaaaaaaaatggcataaccatccagctattcactaaaactagactttctagggtgaatttcaccctttctcattcctccaaaaatttggttatcagttcaggtttagtttgtttgaacatttctgttgaatgacatctcctcacccttttactgcctgtgtgttggttctctttatctttcatttagatgaccgcaaaagaagatactgacattagtatcttcccacaaatagccaccaaatttactgtttccagaagcacaactgcttccgtttttaaaatttattttatagatatatagtagtgcttcagttttttaaaaagccatatcctctttcccgcaggataaaatctgaactccttagcgtagcataaaggatctttcacagtctgactcctgtctattttccatttaaatatctagacagtaaccttttaacccttctatctttcctgcctcattgaacttctttgtaactctctcccttgcacgtttcctcttttacactttgcttttaatgatactgaattctcttcttttaccaaacttatctttcacccaatttaaatatctgttcatcaggtgaactattccatgatctctctgaaaaatttaattactcaacatccctgactcccacagcacattgttcacaggtcttttatgtctttatccaggatgtgttacatttgatctgctgaagtgaatattcaggtaggcgagcttaagctgtgaattttttgaggacattcaaaatgttgattcacatttgcttctccatctccaagcacttcaaatgaactgatttaaaatcttcacccactgcatatgaccttccacgcaatgcctgaatccaagtcctcaaacctctatggtacatttcctcagagcataccttatactcctatcaagccacaatactttcttatccttacctctcagtctttgcttacgttcaagttcaaaagttgtagtccctctttattacatgtcataacccttcctcctttcaactcacctccagacttgacggctgaccagttacacagcataggtattatgagtatgtaggcagatgccaaactgtactgtttgttaaatattcatgttagcatctctgctcaatcaaattagatataactttcttagaacacttatatttgaccttgtaatcattatttatcatacacaagcaccagaggtctgctggaaccagctcctaatggctcatgagaaccaactgttacatttccagattttttttttttctttttcttgagacagagtctggctgtatggcccaggctggagtgcagtggtacagtcttggctcactgcagcctccaccttccgggttcaagcaattctcttgcctcagcctcctgagttgctggaattataggcactcgccaccacacccagttaatttttgtattttagtagagacagggtttcaccatgttggccaggcctggtgtcaaactcctgacctcacgtgatctgcccgccctggcctcccaaagtgctgggattacaggcatgagccaccatgcccaaccatgaatattttttaacaagttgttatatagagacattatttgtaaaattatataaaatagtatttaaaacagatgtaatgctcaaaatttattaatacctagttattgtatgattacttctttttttttgagacggagtctcgctgtgtctcccaggttggagtgcagtggcgcgatctcggctcactgcaagctccgcctcccaggttcatgccattctcctgcctcagcctcccaagtagctgggactacaggcagccaccaccacgcccggctaattttttgtatttttagtagaaacggggtttcaccgtgttagccaagatggtctcgatctcctgacctcgtgatccgcccgtctcggcctcccaaagtgctaggattacaggcgtgagccaccgcgcccggcctgtatgattacttctaattttggggttatttgtgtctactgtgggaatactgttgtgctactgtgcctgtcttctcaacgacagtttcaatcatgtcatacagttaacttcaaattagctataattggcatatttacaccatggccatcaggccttgagttattgctgtgttgattgtctaaacttcagaaaatgatgcaaaatatcaatactgtagtttcaatataaaggtgtaagctaatattgagagtagtggctacatttgagataaatatttagaaaatattattctgttttgggaaagagttatctgattcaggaaataagctattcatgtcattgccaaataagtgtatttttgacatacatattcattgtttttcttttttcttactcattactttaaatgaaaatattatacaacattcatataagaatatagtcatattcagctggctactgatacaaaagttcagcaacaaacaaaaatatacattctgtgaatgaattggctatgtggaaataacaacacaaatattatatatactattatttgaaaaatgtgtactttagatgctttatattaataacgtttatgcaaaaaataagtatatatatatatataagtatgtatatgaacacacttttgtcaagagaaacagttgctaagcacttatagctcactactgataagatgatgaaggtgtcaactgaaaataaatgattgcaagcacttgcctttaagtcatagaatgatagtatgattaaataatattcatagaattttacatgttctaatccagtattctgtttaaaaattgaagtggccagcgtggtggctcaagcccgtagtagtcccagcactttgggaggccaaggctgggggaccacttcaggtcaggagttcaagaccatcctgaccaacatgatgaaaccccatctctaccaaaaatacaaaaattagcagggcatggtggtgaacgtctgtaatcctagctactcaggaggctgaggcaggagaatcgcttgaatccagaaggcagaggttgcagtgagccaagattgtgccattgcactccagcttgggcaacagagtgagactctgtcaaaaaataaaaaagtaaaaaaaaaatacagttatttctaaaatttcctgcaaaacttacagttaaacccaggtctcctgatacccacaaccatttaaggtttactcccaattattgtgccactcacctgtatgatctgctgtaatcccttacatactctggctctcatattcatcacctgtaaaatgcaggtattagaatagatgtgtttctaatattatgcaatgtgtcacctttttaaaagtcaattggtacattatctgaaattaaaatgaaattataaaatatatgccaaaatcaaatttgtgctgaatctatgataggaggatgattaaagtgagaaaagaaaaatcttaattaatacttattaatttcatggaaaataagtcactcaagtaagttcaattaggaaaaaataaattacatttgttaggagtgtttaaagttatcttacaaaatccaaaggtagtaagttcaacggagccccatttgggagtgccgcaatccctcagggaaatctctctcattccttcagcaatcttcagggatatctggttctcctctttctctgcagtttttctgcttcgatgattcatgcatagtcataagctgctactgaagaactttcattgcctaagtcaaaactactccatcatctgctagttgccataatctgacccaattttctggtgtcagacttaaaaattcctgtgagaaagatattataagccttttttgaatcaagaaaaccctctcggtctaatcaattatgatcatgaggtctaggtgtactcagaaggcctgtggagcccaagcaggccaaactcagaaaaaagagcaagggctaagtaggtactttgggatgtttctaagtaacattctacctttttttttttttaaaaaagaaactttattatttgccttgaaataggtattattattatatatattatataataattatgttatatagttattattataagtacatccttaataaaaattgtattgttgaagaatatttgccctttttctggagagtttttaaaattcttatttttataacacttgtacttctgaatgatccacactgaaatcttaaaatccttgatttaatgcatttttgaaagcatgacctttgcagaatgtgtacttaattgcagattatggacaacgcgaaacagatataacattttaaactattatttttgttatataatttttctgtagtttacagcaaaatcaaaatggaaattcccacaagtaaataatcaactaatagcagcttatgtgctaatattaaaatatttctcattaattaatttttataaagaatatgagagaaaaatattaaaattactgactgttgctttaaataagcacaagaaatactgcattaatgttctggaggtcatcaaggcataagaacttcaaaacaagtgtaatcaccaaacttaagaaattattgattttcagaagtatatgccaattagcatttcacatattcctatcattaatatatgattcaccacttaataaattattggtatacaaaattatcagtaagagtcaatgcactattaatgttgacataaagtacaattcaccacttgaaaatattaatataaaaaaataaaatactttcaagagagggtccaggatgggttgctatgggatgggctgctatacccacaattattaatataatgtgtatagcaatactaaaacattataaatatctttacctttttaaaaaatacattttaagcatgctgaaaacctaaggacttatcttaacagagtaaaggattggatttgatgcctggttttctaataaatacttacatgctggcagatatgcttgtcaagatgccatatgtgtaaataaaaaaacacaagcatcaaataaatagttggtatgtataatgaatactcaggagtagcaatagctactgtctactaaaattataacccaatggttattttacaatttcaagaagcaccacggctcgtaatagcagtaatttacatgcaaacagacacaactgtgctattttactaccaattatggtcttatatgtattttcatgtcactgtctgcatctgaaactgcaattaatgtgaaggcctaaagaacacaaactatttcaccacatacacacacaaaaaaatggtaacgaatgctagatttctaaaacaagaaattagtaaatatttattaaactcatattaatatgtaaaaagccacaattcaggcatagagaggatattgcttttctttccagtatttggtgtcatgggaagaagaatgtgtcttaaaagatatgaaaggaaacattcagggccatatgaaatatattttatcacttaggcttctgaaaaatctcagttgcaagtttcctagctttcatggggaaaacattcattcaatgaacattttggatcctagatagtttggatgatatgcatagattaatcattattttctcaattagcttaccagtcaaccatcagagaaaaggcacataccttacaccccaaatatgataaatactgagcatgatgatctttttgggaaaaatgtaacgggaaaaaagtgaatctttatgaagttggttttgtgagcatgtacccattacttttcattaagtagtcaatgtaatcacaaatcaagtttaaaagattctgttgtgtatgtgtgtatatatatgtgtgtgtgtatatatatatatacacacacacatatataaatgtatcacacatatatcattatttaaaagagagatatttggggtgataacttttcattgttcctgcagacatcttgccctatggtgggggcatcagcagaggaggctcagaacagccaagctaatttacagagcccagggcagctcttctgtctagacttaagaaaaggcctagtatagagtagtctcaaatcgcctgttataggggtttttatttactatttagaataattccaaccccatttattgttttttaatgcaataaaccccttttggagcagtatgttaaaaatttaaaaatgcatttttaatgaaatatcagccttgaatttttttcactgacaaagttaatattaaagataaaatttgcacaaaatatttgtcaacatttaaaatccaacatatgagtcctagggacattactaagcatatgcaatatgaaagagaaaaaattaataaagcatcaatgtcttttaaaaattaatacttaggtggatatttatgaagcatacatttgtatttagattaaattatttcttataattaattaaatttttttccaatcaaagtattgtacactcatgaaaactgaggtaatagcttttaagactggcactattagcaaaacaagaatcttaacaattgtcacattattccagttttataacagtaacataagatgcttcataaaaactagttaattttaataatttttggtttttatccacccaattcatggaatcaaagtaaagctttggaaagttcattcatttaaaggtgaaacatttgctattttatggatgctaattaatttcagttaaaaattaaaacactgaagattaaaattgtttatcttatacattaacagaaagaaaatttatatgaaatataaatagcaaaatgtattctcacttaaattttaaaatcttgtcataaagcaagagaataaaataaaaagagtatatatatactatatatactatacatatatactatatatgtattatatatacacacatatataatatatatacacatatatactatatataccatatatacagtatacatatactgtatatatatatacatatactgtatatatacgagagagagagagagagagggagagagcagagctaaaacaaaccctgtattcagatattatctatatagaaaatcctaaataatctgcaacaaaactacttcagcaaataaattaaattagcaagtcatccaggacacgaggtaaatgtacaaaaaggcaacaattatttctatgtactataaataaaaacatggaaattgagtattaatagtgcatttataagtggcaccaaaaatattaaacataggtataaatcttacaaaatatgtgcaagatttgtatgctgcaggttacaatgagatccacacatttaaggtgaattgattttttgaaaggttcacatagaaggaaaaaccctgaaattgtcttaaaacttgttgtggtgcatacatgatttataaatatttccaaataagataccttattcaatcagttgcattagatactgtattttaaaatatacaaatatattctaaacgcaaactattataatttttgtaatgacgattatttttaatataaaaatatatttcggcatttattttcttctgtgctattcttagttgaagttttaaaatgtaaggatttataattcaaagagttttataaatgttttaattttcattttagtgagttctctagattttgttcttatttacttttttcataactatttggaaatattaaatattcttaagattgtattaaattttaattactgggaaaaaaattgaaaagaaaacccattgtaatccaaccccataaatgtcaaggaaggcactgaaaatactaaataaagagtcacaaattgaatataagaatttatttttaaaacttttttggctttattgagttagaattgaaaaataaaaattgtatgtatttaagtatacgtcattaaataattctaacaatgaagctaattaacatattcatcacctcacatggtcgccactttgtgtgtgtgtgattagaacatttaaagtctactttcttagaaaatttcatgcacaaatagcagtattattaattacagttatcatgctgtattaggcttccataagttattcacttattcacactacataactaacatctcctgcttacccgaccccacagctcctggcaatctcctttctattctgcttctaccaattcaaccattttagattccacacataagtgaaatcatgcggtattagtttttctatacctggcttagtttacttagcataatattctccagaattatccatgtcattgcaaacaacattttgttttcttttttaaggctgaataatattatagtgagtgtattattatggggtattttatagtacacatatataatgttttctttattcacgtatcattgcatcaatggacaaagattacttccatatcttggctgctgtgaataatgctgcaatgaacatggaagtgtagatgtcactctgagatactaattcatgtcctttacatatgtacttagaaataggatttctaaatcatatgatagttctatttttaattttttgaagaaccttcatactatttttcataaaggttgtactaattcacatccccaccattggtgcacacatgttaacttttctctaaatactcactgacacttgatatatttgtcctttaaaaaatattcattctaacaactgtgaggtgatatttcactgtgattttgatttgcatttctctgagcagattctcttatagccgttggccatttatatgacttcttttgatatatgtcttttcaagtccaggtgagtccaagagtgcccactttttagtctagttatttattgtcttactattcagtgttattttaggtattaaccacttttcagatgtattgttcgaaatgttatttcccaatccataggctgtgtcttcattctgttgattctttcctttaatgtgtagaaggcttatagtttgacataatcccatttgtctatttttcctttttttacctgggctttggggatgtaacccaaaaatcattgccccaaccaacaagaagatttttcctgtgttttcttttagtagtttacagtttcatggcttctatttaagtttctaaaccgttttgagttgattctttgcatacggtataagtacttaactttatgcatgtagatatccagttttcctaacatcatttattgaagattctcattttcatattgtgtgttcagggcacctttgagattgatcaattaaccataaatgagctgatttctgagctttccattttgtttcattggcctatatgtccactggtctatgtgcctctgaaaagaatgtgttctttcgccagtgtgattactctagctttgtagcacattttgaaatcaggtggtgcgatgcccccagctttgttcaagattgcttcggctactgaggtctgtattaatctgttttcacattgctataagaactacctgagactgggtaatttttaaataaaagaggtttaattgactcacagttatgcatggctggggaggtctcagaaaacttacaatcatggcaaaaggcaaaggggaagcaaggcacgtcttacatggtggcaggagagaaacagcaagaggggaactgccacacactttcaaaccatgggatctcaggagaactcactcagagaacagcaagcgggaaatctgcccccacaatccaaccacctcccaccaagtccctccaccaatactagagattacaatttgagatgagatttgggtggcgacttagagccaaacaatatcaaggacttttttgattctatatgaattttagatatacgtgatcatgttatgtcatctgcaaacagggacagttttacttcttttctaatttggacatcttttatttctttttgctgcctaattgctctggctaggacttccattactgtatggaatagaagtggtgagaatgggcatctttgtcttgctcctgaacttagaaaaacgctatgacagggatgtaagtatgagtatgatgttagcagtggacttgtcatgtacgccttttattatgttgagatccattccttcaatatttatgttgttgagagtttttataatgcaataatgttaaattttgtcaaatgctttttctagtcatacaattattatccttcatcctgttaatgtggcatatcacatttactgatttgtgtttattgaaccattcttacattctagaggtaaatcccacttggttatgatatatgattctcataagagctgttgaattcagtttactgttattttgtcgaagatgtttgcatctattttcagcaagtaattttcttttcttgcagtgtccttctctggatttgatatcagaataacctttgcctcatgaaattagcttgtgggttcctcatcttcattttttttggaaattttgaaaagaactggctttaattcttcccaaatatttggcaaaaatcacacatgaagccattggttctgcgtttttccttgttgagaagtttttgcatgatgattcactacctttactcattatttgtctatttgtattttctgtttttttcatgattcagtcttagtaggttgtattcttctaggaattaattcctttctttggagttattcaattttttgcatataattgttcatagtaatttcttacaatcctttgtatttctgtgatttcagttctattgtctcatctttcacttatatttatttgagtcttctctcttttttcttggttagtctagctaaagagagatatttgaaatattttctttttcatgctggcatttattacacttcttgtaaggcgtgtttagtggtagttaacaccatcagccttagtttgtctgcaaaagcctttatctctccttttctgaatgacagttttgttgtgtatactatttttggttggtagttttgttttgttttgtttttccaagacattgaatatataatcccacttttacttggccactcactaaggtttactgggtcatccttgatgctggaatccaaggcaaagtcaaatgttgacttcactctccttgctctgcatggagagtatttctcttcatgctgcactgttcaggctggactcctactctccatgctgtgcttctactttctttaatttgtcttctcctatttctgcactcaacccaggttctgtaattcctcccctggattccatagctcttgtaaatatgtttttgcatgtgaatagttgttcaagttgatatttccatgagaaaatgagcaccagaaactcctattctgtcatcttgctgatattagtcctcaggatttgatttttaagtgttaaaattgggaaattcttttgaaacggtttctatttgtaattagataaaattttatcttataacataatggcattaaattaagccctaaagtttttgcagcatctaaatgtaacaacacatccccaatacatatcgaatttaacaagttttgtattgaaatattatttataaaaggaatgtgatctaataaaagcaaccaaggctatacctgtgagaatatttataatatttacaaatttaaaaataaaatctatcattataaattttctctaatcttacaggttagttttaaaacagtattttctcatttaaaatattacggtatatagcaaagagtaaaatgcaagttttaaaaatttaaaatttctaattatgtagtacagcactgaataaaattgaagacaattataaaataaattaataataaaaattaaacattttagaacatattatttacaaaatactaagtcagataaattaagaaatttaaagtatgaaaatatggctcagaacaacaatttcgttcatgccattttaaaatttcatacaatcaataaaaggtgcacatgttctcatgttaataaacgcaggtacagttgatcttagaacaacatgagtttgaactgtgtgtcgccacatatatgtggtatgtagattttttttctgcctctaccacccctggtataccaagaccaaccaacctctttttcctcctcttcagcttactcaacgtgaagataaaatgaagacatttgtgatgactaacttccacttaatgaatagtaaatgtattttctcttccttatatttttcttagtatcctttttatttctcaagcttactttattgtaagaatatagcatataataaatataatatagaacctatatttaatcaattgtttatgttattagtaagacttccagtaaacagcaggctgttagttaaatatttggggagtcaaaagttttatatgaattttttacactgtagggagtcagcacccctgatcatcttgttgtttaagggtcaactgtatatgttcatattgagaaaaaaatattttcagcgatatgtttgaatagaactatttttatattaaaaatacaataaataataaatccagcactctgatcactacaaaagtcaaaacgtatatccgtatagagatatttaatttttgaatttccttcattcatataattgtccagattttcagatacagagatatatgtgtgtgtatacatacatatttttttgtttgtttttttaaatatatattctcttctcaattttaattccatcctgtgtccaggtacagatgtatgtatgttcagtacagatggtccagactttcagatatgaatagacatatatgtatataaatatatatatgtttttatatttccttctgaattttaattccatcctgtgtccaggtgcagatatacagatgttcagtatagatggacagctgctttttaatgttttcttttctcttttcttactctgctactaaatatattgttttcttttcaactgaataaaccttttcttgatcaatataacttagagattattttcataattcattcaacaaatattatagaacatttattatatagcaatcaatattctcagaattgagattgcattagtattttaaaatgattaatattcacacacgcaatacaaccattttcatgacactatgacaagaattctgaattaaggctagtgttcttctgaacaattatcataaagagatctgatagagtcatgagatactatccttaagatagcctttagtcgaatttaaacaatatgcattactaaatacaaaatgagtaggaaagggtgtgacaagagcagaggtgtggtgaggttgggacatggtaggtctgagggcctttaacacagtgaacattcagtaaatagtgttgcaaaatgaacctaagaagaaggaatggtcaaacactggagagctttgtgtggcacgttaagcattttatcatttaaatagtctcaagcaaagcataacaggatcaaatgtacattttggaaagacaaaatccacaaaatgtgcacgtgccctttgttgttgtattttttatgtgtgtctcagataagcgaggaggggcagcagaggtgtgagcatagtagctactgacatggagagaggttgttggatttgagagctataaagtgttacaattaataaaactgtatgatggattagaaatgggagatggtagatgaactgtgtcaaagacatccccacaattggatgcttattggacatttagtgagacagaaaatatgaaagagacttctgttagaataaggatgagctcagatgccttgaaaagcaatcaaagcaaaataccaaccaagtagatagtgaactaaatgggcctgaagctcaaagaagagatttaagatggatatacaaatagataagtcacctgcttaaaagtggaaatagaaactatcactgtgaatgacaccatatcaagagagaagttaggggagagtttctcaacagaagcactattgatattttgaaccaggcaattccttgatgtatatggctgtgcatggtagaatgtttggcggtattcctgccttctacccagtagatgataacagcatcaccagttgcaatgagcaaaaatgtctccaggcattggtaaatgtcttctggtacaaattcgttcacaattgagaaacactgggttagagcaataagataagaaaattcattttaacattctgttaactctatgtgatgattcaactctacatgtcttctttcatatgcttatgaaagagtatgtgtttctataaatgtattttttaattatttcttctcaataaagttttcttttcagaaacctttttctcagtattaaaacatatatttggttatcttttccaatggcctttaatttagtgtacattttatttgtactctattatcatcattattttatagaaaagcaatggcactattattatttcatattttgttatctgtgccttaattctattcaaattccacatgaataattgttatgcataattgctaatcctcagaataattaggatattcttggaaaatgtccattttacataaaatatatcaatcattcaaggacatttttctactttgctttggtttaaacgctctgattataattatacatagaaatatccacatatacctgatccacctactacaattaaattcctagcatatttctaagtttttatattgcaccagacagattcataaatgatgtaataatttcaaataggcaattcaaaattgatctatgtaacatatcgttaactctctagaaatgtacttatccagtcatgatgaaattagtacagcagaagtaaaagctaaaatacattactttgacttataaaagttagtgacaaagttgcttagcagtacttagttttctattaaaacaaatggcctaattcgttaagatcactttatgaagttttcttatccatttagatcctgtctatgacatgttcttaacataaatcttactaacctctgaataaatttctctaattctcataggatcaacttgtttcatttatttttccctttttcttgggataaatcttatagaatatatatctttagttttaagtatttttttaaattaagttctcagacttacaggtataatttggttttaaataactgcttgcgttagttatctactgctttgtaacaaatataccaaaacttagtttctttaaaacacgcatttacgatctcattgtttctgggagtcaggattcagggcacagcttagctctgtgtctcctggttcagagtctgttgcaggctgattcaaggtgtcagtcagggacaatccatctcactttacaacagggcaggaaccacttctaagatcactcaatggttatgagaaggaagagggagagagagagagagagacagagaaagagagagagagagagagagagatagaaagaggtttctatttataggtttctgccttgggaagttgtgattgtctgtatttccctgtctgtctctccagtttaaggggcagtgatttgtcctgtgaactcacttctcttacagatctaagaagagctgatttttttttcagttttttttcctttttaatttcttatgtgttagatagaatggtaaccccaacttcctcatatgctgaaccagaaagaagaagtctgtgatatagttttcatggtataactaattaatatatgcggtgtatgctcttttactcatctcttaataccagatttcctagttgatttaattaaaatgaggtattcatgtgtaaatagtttgtattaaagacacattgttaaaaaaatgaattaagtgtgtggtagtataccattgaaaggttaattagatatgcaaataaaaaatgctaagcatttatagttgaattggatttaaaaccaagtcattctctatcatttatttgtattataagtaaagttaacataattatagagtatcaacttcacaacttttctactctatctaaatatattcttctgaaaacacagaaaagctattttttaatttcatgagtgcctgagactaacatataataatagcaagaataacagctaacttattttagtatttgctcaatatgagacaatgttttaagcattttaaaggtatagcatattttaatttcaataaccacactaccattaccatggccattttgtagaggagagcactgaagtcgactctcacaaacttttaccagctgacaacttgttgagttagattccagacattctattacgcactccaaatcaatcatacccaaactgtagtctctgggggcagcaaaagcgtcacctgcgaccctgctagaagtgtagactttcggctgggcgaggtggctcacgcctgtaatcccagcactttggaaggcccaggcgggcagatcacgaggtcaggagtttgagaccagactgaccaacatggtgaaaccctgtctctactaaaaatacaaaacttagcgggacatggtggcgtgcacctataatcccagctactcaggaggctgaggcagaaaaattacttgaactggggaggcagaggttacagtgagccaagatcacgccactgcactccagcttgggcaacagagtgagactccatctcaaaaaaaaaattaaaaaaggccagcgtggtggctcacgcctgtaatcccagcactttgggaggccgaggcgggcggatcatggggtcaggagatcgagatcatcctggctaacacggtgaaaccccatctctactaaaaatacaaaaaattagccaggcgtggtggcgggtgcctgtagtcccagctactcgggaggctgaggcaagagaatggcgtgaaccgggaggcagagcttgcagtgtgctgagatagcgccactgcacgccagcctgggcgacagagcgagactctgtctcaaacaaacaaaaaaaagaaatgtagactttcagctccccgccagaactgcacattcagaatatgcattttaataagtgcttccctatattataaactactccactgcatttagtagtagtaagagtttttgctgtttttatagactctgatgcacaggttgtgaccgtattccttcatttacgatagaaggggtttcatcattgacccaatatagcatgtattaggttggtgcaaaagtaatcgcaggtttgccattgaaagtaatggcaaaaccacaattgcttttgcaccaacctagtatataataaactccttctcttatctaatattagaactagcatcttgacaatttaatgacatataagtatgtagtcctccttttttttccttacctgagtccctgcctgtctcagtacagctaaatttcctgtttggttaaaggtgaatgtgttaaaataataatggagtgtaattcatggatataagaaattaattctagagttaaattttgtcaactcttctcttttctcaatacatcaaatattgtgtttaacacattctagtattttattctacatcagtagggtattgattagaagaattccaaattattttacacaatattgaataaataatttaacctttaaaaaattgaagtacatctaagaagaaaaaaaatgaagatgtagaaagagagagtaaataaaaagatatgttattttaataaacattaacttgacagaaagagtagttgccttgctgtcaatttgtaagcttttgtcatctagggtttaggtataatacaagtgattgcttccaggttccaagggtgttcatcctgttagttaagcatagtacctacagtcagaacaatgtcagggattacttctaatttggcccattgttagcaaaccagtagaattctccaaaagtaggttttctaatttgtggtgagatatcacattcatgaaacataattttccaagaggaaacatcctttaataatggaaaacaactaaatgtcatctatagcaaacacgataatctacattggagcgtgcctactagttgcgagtcttgaacagaacacttatagaaatctgtgtcataatttcatatgctctattgttttgattctttctactttagcatttaaaagagctaagattacaaccagatgaaatgaaaaaaatcataggaattaagcaaaaaaaaaagtccgaaattgctgagatttaaaggaattcaaatgatgcatacatataatattaagccagctcaatattttgcttttacctgaaatatatggattagtagattcagataatttccttagttttttattgcacgtttcatatatcataaaacaaagtaaccaattaaagttaaatggtattaacattttaaaacattcacaatatttaatgaaagccactagaaataaatgaagtcactacatatagtaggaataatttttagtgtaggagtagaagcagcagcgattgcaggctcccatcagaaaaaaacgtaagtgtgtgaagcctttactggcaaccaaggtatccaggttctctcatcaaaaatgactagaagaccggcgtgacccacagatagaaggaagagcagtgtggtgtcgtggcccacctgagaaccacagggggaaggagaacccctttcccctcagccaagggaggtggttagcaagcatgctatccagccagggaaactgtgctttttttcatggaactgtgcaacccacagattggaagattccactcgtgaactcacaccactggggcctagcgtccaaccccaaggcatgcaaattcttacagcctctcagttggaatctgcttaagcctaccaaactcccaggggagggatggacaactagtactggctgtggctgcctgttgtctaagcttttgagttccttgggggaggggcagcagccatcactaggacttgcaactgcctaacacactaagtttcttgggcaggggaagggtggcacccatttccatagctccaggctgcacttttcccctgctggagccagggaggctggacggcttggtcccaagacttgtccccatagcccaacacaccagttgtggcagtctgtggccaaagtgcctcttcaggtctaaccctgattcatccttcttcagtagctggggcttccctgcaagatctccaataactccagccacaggctgaaggacagaattcggatctccccaggcctgagccccactacagggggagggctggcagcagtctctgcagaccagcagacttagcctctcctcctgctagttctgaggaatctagcagcccagacaagtgggttccccccagtgaatcacaccctctccaccaaggggataaagtgcttccttaaatgggtcctgttccctgtgccacccaactgggtgagaccctccaacagggggtgtcagacaccctatacaggagtgatccaactggcataaagttggtgcctcttgaggtcagaggtcccaaaagaaggggcaggcacccatctttgatactctccagcctgcttgagtgacatccccaagcacgggagcgaatcagatgaataggacctgaagtgaacccacagcaaactgcagcagccctacagaataaggacctgactattgaaagaaaaacagacaagcagaaagtgacaacaatagcatcaacaacaacaacaacaaaaaaggccccccaaaaaccccatccaaggatcagcagcctcaaagactgaaattagacaaactcatctcataaagatgagaaagaatcaatgataaaatgctgaaaacccaaaaggccagagtgcctcttctccaaatgattgtaacgtttctccaacaagggtgcagaactgggtggaggatgagatggatgaattgacagaagcaggcttcagaaaatgggtaataaaaaactacatgagctaaaggagcatgttctaacctaatgcaaagaagctaagaaccttgataaaagcttagaggaattgctaactagaatatccaatatagagagtaacataaacgaccaaatggagtagaaaaacacagcacgagaacttcgtgaagcgtacacaagtatcaacagtcaaataggccaagtggaagaacgaatgtcagagtttgaagaccactttactgaaataagacatgcagacaagaatagagaaaaaggaatgaaaaggaatgaacaaagcctccaagaaatatgggacttcataaaaagttcaaatctaccattgattggagtacctgagcgagacagagaggatggaaacaagctggaaaacacacttcaggatattatccaggagaacttcccaacctagcaagacaggccaacatgtaaattcagggaatacagagaacaccattaagatactccacaagatcaaccccaagatacataatcatcagattctccaaggtcaaaatgaaggaaaaactgttaaggacagccagagagaaaggccaggccaccttcaaaggaaagcccatcagacttatagtggacctctcagcagaaactttataagccagaagagattggggaccaatatacaacattcttaaagaaaagaatttccaacccagaatttcatatccctagccaaactaagcttcataagcaaaggagaaataaaatcctttccagacaagcaaatgttgaaggatttcattaccaccaggcctgccctgcaagagctcctgaaagaagcactaaatatggaaaggaaaagccagtaacagccactgcaaaaacacaccaaaatataaagaccaatgacactacagagaaactgcatcaactagtttgcaaaataaacaaatagcatcatgaggacaggatcgaattcacacataacaatactacctttaaatgtaaatgagctaaatgctccaattaaaagacacacactggcaaattggataaggagttgagactcattggcgtgctgtattcaggagacccatctcatgggcaaaagacacacacaggcttaaaataaagggacagaggaaaatttaccaagcaaatggaaagcaaaaaaaaaaaaaaaaaaaaaaaaagtaggggtttcaatcctagtctcggacaaaacagtctttaaaccaacaaatggctgggtgcagtggctcacacctgtaatcccagtacttttggaggccgaagtgggtggatcacaaggtcaggagtttgagaccagtctggccaacatggtgaaaccctgtctctactaaaaaatacaaaaaaagttagctgggcaaggtggcacatgcctgtaatcccagctacttgggaggctgaggcaggagaatcactttagccgggtagcagaggttgcagtgagccgagatggctcctctgtaccatagcctgggtgacagagcaagactctgtctcaaaaaacaacaacaacagcaacaaaaaacccaacaaagatcaaagaagagcattacataatggtaaagggaacaattcaacaagaagagctagctattctaaatatatatgcacataaaacagtagaaaccagattcataaaacaagttcttagagacctaaaaatagacttggactcccacacaataatagtgggagactttgacaccccactgtcagtattagacagatcaatgagacagaaaattagcaaggatattcaggacttgaactcagctgtggatcaagtggacctcgtaggcatccacagaactctctaccccagatcaacataatatacattcttctcagtggcacatggcacttattctaaaatcgaccacataattggaagtaaaacactcctcagcaaatgcaaaagaattgaaatcataacagtctctcagaccacactgcaatcaaattagaactcaggatgaagaaactcactcaaaatcacacaatttcatggaaattgaacaaactactcctgaatgactcctgggaaaataatgaaattaaggcagaaatcaagaagttctttgaaaccaatgagaacaaagacacaatgtactagagtctctgggacacagctaaaacagtgttaagagggaaatttatagcactaaatgctcacatcagaaagctagaaagatctcaaatagacaccctaacatcacaattaaaagaactagagatgcaagaacaactaatctaaaaggtagcaaaagacaagaaataactaagatcagaaatgaattgaaagagataaagaggcgaaaaaccctcccaaacgtcaacaaatacaggagctggttttttgaaaacattaaccaaatggatagaccactagctagactaataagaagagagataggaatcaaatagacacaataaaaatgataaaggggatatccccactgaccccacagaaacagaaactaacatcagaggatactataaacacatctacacaaataaactagaaaatctagaagacatgggtaaattcctggacacatacaccctcccaagactaaaccaggaagaaattgaatccctgaatagaccaataacaagctctgaaattgagggagtaattaatagcctaccaaacaacaacaacaacaaaaacccaggaccagacagattcacagctgaattctaccagaaatgcaaagaggagctggtaccattccttctgaaactattgcaaataattgaaaaggaggaactcctccctaactcattttttgaagccagcatcatcctgactcaaaaaccgggaagagacactacaaaaaaagaaaacttcaggtcaatattcctcatggctaggaaaatcctcaataaaatactggcaaactgaatccagcagcacatcaaaaaacttattcaccacaatcaaattagccgaatccctgggatgcaaggttggttcaacatatgcaaatcaataaacataattaaataatccatcacataaacagaaccaaagacaaaaagcacatgattatctcaatagatgcagtaaagacctttgataattttcaacattcctttatgttaaaaactctcaataaactaggtattgagggaacatttctcaaaataacaagagctacttgtgacaaacccacagccaatatcatagtgaatgggcaaaagctggaagcattccctttgaaaacttgtacaagacaaggatgccctctctcaccactcctattcaacatagtattggaatttccggccaggacaaagagaaaggtattcaaataggaagagaggaagtcaaattgtctctgtttgcagactacataattttatatttagaaaaccccatcatctcagcccaaaaacttcttgaactgataagcaactttagcaaagtctgaggatacaaaatcaaagtccaaaaattacaagcattcctttacatcaacaataggcaagcagagaaccaaatcatgaatgaacgcccattcacgatcaccacaaagagaataaaatacttgggaatacagctaacaagggatgtgaaggacctcttcaaggaaaactataaaccactgctcaagcaaataagagaggacaccaacgaatggtaaaacattccatgctcatggataggaagactcaatatcacgaacatggccatactgcccaaagtaatttatggattcaatgctatttgcatcaaattaccattgacactcctcacagaattagaaaaaatgacttcaaatttcttaaatgtaaaacccaaaaccataaaagccctagaagaaagcctaggcaacaccattcaggaaataggcatggacaaagacttcatgacaaaaacgccaaaagcaatggcaacaaaagccaaaattgaaaaatgggatctaattaaaccaaaaactaaagagcttctgcacagcaaaataaactatcagagtgaataggaaacctacagaatgggagaaaagttttgcaatatacctatctgacaaaggattaatatccagaatttacaagaacttgaacatatttccaagaaaaaaaaaaaaccatcaaaaaagcaggcaaggatatgaacagacagttctcaaaataaaacatgtacatggccaataaacatatgaaaagaagctcaacatcactgattatcagagaaatgcaaatcaaaaccacaatgagatactatctcatgccagtcagaatggagattattaaaagtcaggaaacaatagatgctggagaggatgtggagaaatagcaatacttttacactgttggtgggagtgtaaattagttcaaccattgtggaagacagtatggtgattgctcaaggatctagaaccagaaatactatttgacccagcagtcccattactgaatatatacctaaaggattataaatcattctactataaagacacaagcacaagaatgtttattgcagcattatttacaatagccaagacttggaactaacccaaatgaccatcaatgatagagcggataaagaaaatgttgtacatatacaccattgaatactatacagtcataaaaaggaatgagatcatgtcctttgcagggacacagttgaagctggaagccataattctcagcaaactacacaggaaaagaaaaccaaacactacgtgttctcacttataagtgggagttgaacattgagaacacatggatccagggaggggaagaatacacaccagggcctgttagtgggtgggtgtaaggggaaggaacttagaggacaggtcaataggtgcggcaaaccaccatggcacatgcatacctgtgtaacaaacctgcacgctctgcatgtggatctcgtttatttttttagaaaaaaaataatttttttgtgtaataaaatacacataacataaaatgtgccaccataaccatttttaaatgtatatttccctggcagtaagtacaattatattgttgtacaaccatcaccaccatccagtattaatattcatacccatatatcagaagaactgtgataagaattttggtagtatcatgaagttgggcccaatgtcagataatctttccctcttaatagataactccctattcatttcctattgtgggcctatttaagaatattagttgtcattgttatgtttgtgaaaagaacattagtcctagcatcagaaaatctagcatacagccataactctaccatgtatgaggaggtgtttaagcttggctaacataattacatatcaagaaaaatgagtaatccaaatctgtctggttactggccactatgcaattcaaactcacacatgcagctgagccatactgtcatctctcttacgtgccaatatactctcttttacttagtgtttacatttagacaaacatgtaaagcaagctgaacaaatacgcaaaaacaaaaacaaaacaaaaaataagaacaaaataattgtgtctgttctgctaccatagttgtccaccatgatttattttgtgatacctaagtcaaagcatatgttaggcaaaactaaatagtttatttatactaaattctgtgctgcaaaattgtattgcagaaagaatgctctgacctcattgtataatatttgctttaaatcaagcaaacatgtaaatcttaggagtcatctaaaggacaagctaatttaactataaattggttcaacattaatcagaagtatttatcaaactcctcaaatactataaaattaaaatgcagttaggtgtttttctaatttaacatgtgaatattgtttaatatatttacttcaataatttgtggaaaatataatatctttgagcatctgtgaaaataattccagataatatatgagaatgatgatgctttattttataaatacttttttctttgttaatcaagctttattcctttgatcagtagtagcatttgtcactttcctgaagctttcaaagtaacttagaattatgatagactggataaagaaaatgtggtacacatacaccacgaaatactatgcagccataaaaaggaatgagatcatgtcctttggagggatatggatggaggtggaagccattatcctcagcaaattaacgcaagaacagaaaaccaaacagcacgtgctctcacttataagtgggaactgagcaatgagaacacatggtcacagggaggggaacaacacacactggagtttgttggggttgggtgacagggggaaggagagcatcaggatatatagccaatgcatgctgggcttaataccttggttttgggttgataggtgcagcaaaccaccatggcacacgtttacctaggtaacaaacctgcacatgtatcccagaacttaatatatatatgtgtgtatatgtgtgtgaatatatatatatggtatatccatgttgaaatattctatcactcatttatatatttgaattggattgtcttctacatttatcagatttttggtattcattgtaataggtagtatttttagtcttttattataaagacatacatattttcgcaactgtgggcatatttactgaatgtcctttttttaaatcacaaagccacgggttcatgcctaggtttagtaatatgaatacaaataaggctgttagaattctaaacatgaaatctcataatcatgtacttatatggaaatattataaaaagagtattaaaatgtgtcttttctaaaattaaaatttatattgaataatatgattttccattttacaattagaaagaggataagtgtattgtacttgtctgtatctcatagttaccaattttatttattgagaaaatagtatgtataaactttttttatataaattagctagtttctttctcacaaatgtctttggggataaatactattactttctccattttacagatgaggaaatttaaacatatggaatttaaataattgggcttaaatctcaatataatgaatggcagagattaaactgatatctttcctgatgatgataaacccatcatgtgatgaactggccaactatctttattgtgacaggaaacatctgttctcaatgcaatgaatttgtaattttgttgaagatttaaagaatgtacaagaatcagcaaaataggatatatatatatctatctatcttatatatatattatacagcagtcaagtcaactcttgaccattgttaaaactgttgactccactagctggagaaggagccgtggaatcctggaaacttagcctgtccttgactgtcaggtatgatttgcacagacagaaaggagtaatcaaacattttcaatagaaggaacgtttccaaaaatatgcattaaaaatctgaatggacattcattagaagactctgaagatatagacctgagagcatttatacactgagaactagatgtaaaataaagttccccatgaaatattatgattttgcaagtcacttggttccattttaaaaatgttgataggattgaagttatatgtcagctagcaaagtgctaagaatgaattatatttcaaatttggggttaataaattctctgaggagggcaattgataaaagagtgcataatgagcagtatttcccaagtagtatcagatcaaaggaaggtttatgctccacttttcatgcggctccattgcatcatataccagagggcttataaaaagtgtgcttttttttgaagttatctgatgcaatatcctggatgaccccaatcgtgagatcattgctagggttctgagtattcatatatgacagaacagtatcccagatgccagcactgactcagaataaaattccttaatacttagctgatattaataatagaacattttgtgaacccaaaatagcactgagggaccaagaagtgaataagtcatgtatgtatatcattattagtcacactctttcctggtcaagtgatatggattaaaggaacataactgcaggtgtttggggtcagtgtcattaacctttcccctaatgagcttcccttggagaaatgaatggaaatgcaattaatgataaaataagagtaaaagtttgtagttgtgtagtttctctgcaattcttcaccagaaagaattcaagtattcctgctggtgattgctctgtaattatttcttttatagaaatacaaggagactgtatttttaaagaatcctgcctttttatagatggagtttaaaagtactgtactacgcattaggatgaatacaatgcgggaaagtggccatgatgtccttgttttagatgacagagtttaatattagactatcatgtcctaaatttgtgagaaatcagctgattctaacaaagaaaaaactaaaatcagtgacttgtccgaaggcacggtccccgaaaacacaccttatatttataggaagattcacaatacaggagaaaacattatgttcttgtttctatgacatcacccactcctcattcatttcctgaggtgtgacttaatctgcttccatattctctgcaagttcattctcttccaactggccattcagtatggattttcttatgcctccatacaagagtctcatcttattgtatcttctctgcctatgcaatttcatccataaagttatcatcacatatataccaatgatttctaaattcatagagctctggcttatatttgtgcaaacaaatttatctccttgatgttgttattgaatgtcttaacaggaaatctattacaaaatattaagacacaaatcttatgagctttctctaaaaacattgtccttttgtgaggatctttatttagaaaatggcttcaacattcttcctgttctaaagggcagtaaactggtatcatgatccactctttcaaattcagtaaatcaccaggtcttattgtctttgctttgtttcctaggacaggtatccctaaatgaaggaactggatgcaaatttattttatctgggaaaatatcccaggaagtgatgatgaagggaggaagggaggaagccagagaagggagaaaagccaaaaaatagatgtattatcagggaggttactgctgcaagcaagtggcactgaattcctctgaggaacttctgaaaaactacataatatacatctccaaattgttacttctctgtgaaggaggaaaactctgggtatttatccaccagcctcctttcatctgtcattgagtgaggattgctcctgggacattaactctagctcttctcacctactctggaaaggggcagagcatactccaatgatgagagaacatgctgaagcataggtatatagagtgccctcagcacgtttggaacttagtacaggcctcctgcagggtaggatgaatagattcaagcagggcactgaaggcatctgctacatcggtcagttttatgggaacttctctctgtttctgtgtctccactctcatctaagcttttattccctcttacttgaacactcaactaatttacctgtattcccacatttattgcaaccagggagtctttctcaaaacacatctgtgagtatatcattccccgccatcttaaaacgctttggtggatttaccttcttcctagaacaaagagcaaaaattaaactgttcacaggtaatagaaggctctgcccagtctggtttctgtgattccaatctctctctctttttttaaatttattttacaatattccccatggtttttatgttctagtcatatcggtctttatttttaaaaaataatgccccaactacaatatacaccatctcattccaggctctcgattctaacatagactattttctaacgtactgctgccaatttcctttcacaatgcatactctgtttacttagttctttcctcttcggtatttgaaatacagcatctcaagatattttctccatatttttggtgttcctaattgtctgatagacactaaaatggtgcgtagacagcctagggactaggcactgctggttgttccttagatagcaccctaattgccctttgtcaggagttcttccccaaacttagtgttcttcttctttactgtacagtcagacatcgtaattacacaattacttgtgggagtgttgtattgattgtgattattgattctgctatttactactaataaatgaacttggctaacttatatgtctctctgaactttagtgtacatctgacaattgggaactataattgtgcatacctcacaggattgttatgagagttaaatgaagttgttttatataacttacttagcgcagtgcctggcatacagacagatttcaataaagtttagctattataatcatcatcttcctcctcttcatcacgtcagtatcccacacagttctctccctcctaatcaaatcaaatagtttcttactcctttcttcaactaatgttttcagctcctgagtggaaagaaaataaaatcccttcttacatggcaaaaatttaaaacagaataaaactaatcatgtgtagggaagtaaatttccaaaattgtttgattctttaacagctggaaaatgaaaatctttggtgatcacatactggcatggtatcacctagagtaaaagcattagctgcaagtgaaacaaaagataaacaatagattcaattgcactctgttaagtagcacattagaacccagaaatatctcagtagttcaaataaaaatactataaaaaagtaggaatctaatgaagacttgaaaacaaactgaaaattgacaatgtgtcaaaaagcatcttgtactgaattcagcttaacgttatttatccaatcaaagaaataatcaccggtgcattacacatagcaatatctaagactttgttttttgttttattctccttttctttttacagaatatgtgaacccagcattaattcctttttattatttttattttttccttatgtatgtcaagcctttgttaagctcaaataagcctaaagtcagtgaggattacagagaaactttgcttttagcccattttaaaatgtcaaatgcattttctccaatagcattttattagcataaatgtctctgctccttttgtcttccccgatgtttagttgtcttttagtctttaatatagagttcacaagttataataattggaaaaaaaacaacattcatgcttattacttaggaagaaacactcagcctgaacagatctcttaaatattttctgtttttcctgttaatttatattgcatcatggaaagtatattctccccaatgactgttaagaattactatgtattttaaatattattccttttttttttggtttatactatcttttgctaagacattgaataaacacatttacaaacatttaattacttttgaaagaaaattgattaatatagtattaaattcaaaacaaaatattagaatactttttgccatttaaaatattatttttccaaaattttataaacttacactgccctaaaatattttattccaagtagttaaaattatgaattattatattatacaaataaaggttattattaaaaaatgatgattcaatgagatgtactagagttataatgattagagtcatgaaaaaattagaactgcttttgctttaaagaaaataacaatagtagatgaaactgttaagttttgttaccttgaacaacctggaaaataataaataataataattaatatgttaagcataaggtatcattttttaaaacatgatatttatgtttttaaattaaaccttagttctaaaagctgtacttctagaagtttctgttttaaaattttgtactttttcagattagttgtaaattccccatagagaagagtatcattttttatttcaatgaactgcgtaacctactcttaggctctcaaatcaaaacttatatgtaattatgcatttatgatattgcaccaacttgtggaattgtctctcattacattccaaacaatatttcttctgatgtatttaattctcatatggcacttacaattttaaccatgcatttaattcctaaataactgccatcaatatttatatggttgaacttttatcctattatatattgtataattgctaccattaattcatttcccagaggtttacttttcagagttatatagtgtttcaatgtcatattattttgcaaagctcactttttatgatgtaatagtcaactctaggctttaacccaggctagtgattaatgacaacccattaacatgatttattaaaaaaaaactttatttttttaagacccctaattattgtgttgtcaatagtctatttcattagtgcttacttatgagtggtaatatttattttgccttgagagtaagacattgtattactacctttatatctttgtacttttcatcttaaatgtaatcataattataactcataatttttcatgaagccaaatattttaaaatataaatgatttcattataaccaactctttggctttctagtactgctgggtaattatattaaacaaaaaaactctataattttgtatcaaattttaattttccacccatttttacagtgaattactcaaatatgatcttaatgttatacaacctgacaaaaagcatttaaaattatatttgctgttagtgtaccactattctataaaaattcaaatccctttcctcattaaagtgtgagtttatagatccaataatgacagattccaattccctttcaaaatatttcataatgtatattgcatgtttttactagggcagattactactttgcattagtataaacgctttggaagatagcttttttgacaaggtgcaatattgaatacataagtagttaatagtgcacaatgtgctataccaattgatcgaaccagaagaaatgaatatacatgaagtgcaacttgattcatccattacctttcaaagtaacgcaagactaaaatatatttactctatggcaacattctgcatctaagaatcataaaggaaaacataagtacattaaaaattgtaatgaaacataattattgaatggcaacaaaaaatagtacagttcataaatgaggtataacttctcctcaaagggttttaaatctataaagatgtacttatggtttattttattttattttttaatatttttcctttttttagctatttcttttgtaattttttttcattatactttaagttctggggtacatgtacagaacgtgccattttgttacataggtatacacgtgcaatggtggtttgctgcacccactaacccgtcatctacattaggtatttctcctaatgctatccctcccctagcccccaaccccctggcaggcccctgtgtgtgatgttcccctccctgtgtccatgtgttctcattgttcaactcccacttgggagtgagaacatgcagtgatttgttttctgttcctgtgttagtttgctgagaatgatggtttccagcttcatctatgtccctgcaaaggacacgaactcatcattttttagggctgcatagtattctatgttgtatatgtgccatatttcctttatccagtctatctttgatgggcatttgggttggttccaggtgtttactattgtgaatagtgctagtgctgcaataaacatacgtgtgcatgtatctttatagtagaataatttataatcctttgggtatatacccagtaatgggatggctgggtcaaatggtatttctagttctagatccttgaggaatcgccacactgtctcccacaatggttgaactaatttacacttccaccaacagtgtaaaatgttcctatctctccacatcctctccagtatctgtttcctgactttttaatgatcaccattctaactggcatgagatggtatctcattggattttgatttacatttctctaatgaccagtgatgatgagctttttttcatgtgtgttggctgagtaaatgtctgcttttgagaagtgtctgttcacacccttcacccactttttgatggggttgtttttttctcataaatttgtttaagttctttgtagattctggatatcagccctttgtcagatggatagattgcaaaaattttctcccattccgtaggttgcctgttcactctgatgatagtttcttttgctgtgcctaaactctttagtttaattagatcccatttgtcaatcttggcttttgttgccattgttcttggtgttttagtcatgaagtctttgcccatgtgtatgtcttgaatggtattgcctaggttttcttctagggtttttatggttttaggtcttacatttaagtctttaatccatcttgagttaatttttgtataaggtgtaaggaaggggtccagtttcagttttctgcatatggctagccagtttttccaacaacatttattaaatagggaacactttccccatttcttgtttctgtcaggtttgtcaaagatcagatggttgtagatgttggcattatttctgaggcctctgttctgttccgttggtgtatatgtctgttttggtaccagtaccatgctgttttggttactgtagccttgtagtatagtttgaagtcaggtagtgtgatgcctccagctttgttcttttggcttaggattgtcttggctattcaggctttttttttggttccatatgaaatttaaagtagttcttttccaattctgtgaagaaagtcaatggtagcttgatgtggatagcactgaatctataaattacttagggcagtatggccattttcacgatattgattcttcctatccatgagcatgaaatgattttccatctgtttttgtcttgtcttatttccttgagcagtggtttgtagttcttgaagaggtttatttttaaagtttacatttttagtgaagtagtgaattatactatccataattttctacaaacattattcaaaaatgacagatgattttcaaatttaaaaatctacttgataatcatatcctcttgtctaatcaattttcattggaaaactactctttgtaatagcatgttttatttcttaattaaatctatgtgtttaaatgcacaaacacgatacatatgtgcatgtaatatatatatatatatatatatatatatatatataagagatttttttttagtgaagagagccaatacttctctaatgaaactggctttgcccagtgaatgttttttttcagtgctctgtgaagtccgtatattaactctgagttgaagaaatggggagtgaaagaggattcttaacaattacttacagttttgaaacgctggacatttctgatttctatttgatcctgccataaacaaaaagacctagaacaagttagttgaaaagtaaatctgtctatattactaggtcagtgtattattattttaacatgttattgggaaattttattttagagtatgtggtagatagatttctaagatgattcatccccttgcataatcctttgtcaagtgtaagcaggacctgtgaatataatagaatatcagtcctatgattggattacattacatggaaaaaggtattttacagatttaatagaggtctctagtcagttggctttgtattattaatcaaaagagagattatcctgagaagaactgacctaatctagtggtgagtctttaaaagggactcaagtcaggagacaaattccaagtaaaagagatactcctcctaccctccaacaaacaaaaagtatgttgtgacctgcctctggaggaggccatgtggcaagaagctaagggcgccctctaggtgctgagagcagtccctggcccacacccagcaagaaaatgttacttcttttctacagaggggcaaaactgaattctgataaccattgagtttgggagaggactctgaacctcagatgagatgacagctgtcactgacatcttgatatcagcctagtgagaacctgagcaggggactcagttaacatgtacccagattccagatccacagaattgttgagataataaatctatgttgttttaatttgtactaatttgttatatagcaatagaaaattaatacaggatgtaaagagaaggaatatagggatttagagaaatattagggagactggtaaaacaaaaaaaaaatgccagaaaaaaaaaacagaaaaaagttgaagcataaggtatctgtattcatttttctaccatttgtgctttgtttctaagccataagtcctatgtttagtcattgtccactaactacatgtattacgaagtttttaagtcaaagattaatattgtatatttatattggtgtcatatctatttaggctattaaattatttttataagcactaacacatctttgtcattttccatctatatctttattttatatatatgcctaatatagaaagaatgagctaaatttggaatattattcatgatataaatggatttgaattttttgttattatatggccataagtgcaatcatataataatgtctatatcttggtcaaaatatgacagattaaatttttaagcatctatcagcctcaagatcttaaaacttataagtactactaaaatatggctgtcataatagaaaccatgaatatataaagtaaactgatttcatggtacgcccagcgttgagttcattgacagttgatttatgcatttatattttcatcattcaagtattaagggaatgctaactttataaaaacaggaaataacctgtaaaggtcacttttacttgtcaacttgttatggtatagtgcccctgttattcaatcaaacactaaggtaggcacagctgcgaaggtattttgtagatgtgattaaagttcataattagttgacttttagtaaaggagcttatcctcaatgatctgagtggcctgattaagttataaagctttattaagaggagaactgcaaaagcaattctccctgtggactgcagcttcagctcttgcctaagagttccaggctgccctttctgatggcctgccctataaatttcagatttgcttagccgtgcctcacaattttgtaagccacatccttatgataaatcttttgataacacatatatcactgatacatatatatcactcagttttctggtggaactctgatacatacctcttttctttgcaaatttatagcaatcacagaggaaactttcatggatataaaatcattaggtaaaaactttttatgttgtaaacatcatcaaagtcatgatgtttaaaaaaccaaccaaacaaaaaatactagcagacaaacacatctaccatacagcaatggaaaattagcagccccaacattttattctggattttctgaagaaataaattaagatgatatccacatatttccataaaaagctttcaaaataagtagtacttactactctatgtgcatatgattattgctgaattggttttcagtttggattatgcatatatatgatgcacatatatggcattatgcaaaaaaatgttaaatgctaagaggaatatgaggggtttctgagagagcatgtactttcttatgagggcaagctttaaatggcattgaggtcattatcactagggattcaatcatttccaacaatcccttcaaccgggaggattatgggctgacatctcattattgaagtactgaaacatgaataatttgtcctacgttgataggagatactgaaacccatatagttatgaggtcatagctgtaaagaataaactctaaaattattacaaaagaataataatgggaaagaaatactaatgaaaactatgattgtatatacatcccatgtaatttacatatattcatcatcttttgttaaataaatatggttatcagatgtttatcttgtttaaataaaattgcgttttttaaaaaagtctattgctgatatttccaaatttcctatgaaattaagtggcagagaaggaatataaatgagagaaaaaagcaaaagattcatgagttaatgaagtagtcattcttgggactgaaaacaggtacatccttctctctttggtttttcttatataatataatatgaaataataaaaatgccgagtcattgcatgttcagtgaacagagtaaatttgaatacagtatcagaagtgtggcaaagtaaatataaatattatttataaaggaaatctgactttccaagcatatgtgaaattattcatatttaaaacaaaaacaatacaaaatcagcttaataatgattttacagcagttgttacaaagaaccagtgttaaaattttataacaagtttactagtagactatgcaaatatctctgtccacattcttaaagagaacagaacacagattaaataagattagtgtaagtgtgtaagcaactaaaggtattcagtgttgcagtgaaaattagcctgcagcatagagctgattttgctatttcaaccaaactacatcattgccagccatattgaaaatctcatttgtccaagaattaaggataaataatctctaatttcattaagtaaactttgaattattgaaaatatgttttattattaaaagaaagcattggaaaatcatcagctattcctttaatctatcttttaacaaaaaatacaataataaagactaacatgaaacagagagacactcacaggttatataaaacctctaggcccatttgtccagcatttgtaaatctcttatcgagagtgaagggcaaaaaatatatttagttggtttcctcatagatggatgttgacttggaaaaaaaatagaactttaaaaaaaatagatcttaaaaggggctacatgttttttactgataaaatagaagtacagaaatatcacgtttctcttaatgcttctgtatgcagtttatataatattttgcaatattctcttaaaattaaaatgataatagcaaatgagtaacagaagaattgagatgatagaactaaaattaagaatttttggtatagaacttttgagaaatttacatgtataaatatatatgtatttatatgctgtaactctacatatgtatttatacatgcatataattaagaatattataatttcaaaaagtgctgatgaattaccctagttttcacttcctccaaatatttttaattttctactttgtatgtcctttcatacagtgttttatcttgaacacttatctgaaaataaataatttctcaaaagatcacaataaagtcacatggtcattgagttcatgattttaaaatgcatttatttatttttatagaaaccaaggttgtcgtcttccatggtccttggtgaacttcccatgctccatcagcctgggtgcacagcataagcaagaacaaaactattgttttaagacctggagtggttgggtaagggcaaggttgtgtttaaagatgcatcagaattcagacaaaggaatagcccctaatatcatactcagatactttttctgtcatctgaagtatacgtgtcctcatcctcctcagggctgtgctgttcttggcatctttcacagccactgctatgctcacactggtgtatacacttcctgtggtggctccatcagaagccagcgaagaggtgattctattgtatttcttagagtattacgtgaagccctatgccaatttgggccattccttgtgggcctctttctgagcattgtcatgcaccaaaagcaccaagaaaacactctcagaaccaaggtgcaggccctgctgggtggagatgctccctggtcagcctatttgctgtgaccactctggcatatgtggtggacgatgcctctgcttcctctctagtggctgcagctctctaccaagccctccaccagatctgcagctctctaccaagtcctccactggaccccctcaatttccagcgatgaggcttagggttgaggatagacttgagatgctgggatccaagttctcagatgtgtgttttttctaggtgtataacttcatattaaccgtctacaacttgtggatgtctcccatcacttataataaagctctttgtttgcttaaaaaaaaaaagtcctttttgtatgccacagaggctatggaggtctggtgaacttcgtgctttcttgggacatctggattttttggccagcatcagttatgcttgctacttactctggtcatcctctgcaatgagcttcaggaaacacttgctcactgcactgacaagatgttctatcttttctctggacactgtctgctgaccttcattactgggctggccctgacgctattcactgggaaaccatcctgggaactgaagcagttcctggtgggccatgaatgttctggttaaaagccagaagaatggatgggtctttgttggtggtgacaagcaaagaccccgtggccttgtttatgtaatgaatgcttgtgttgctgagaaagggtgtaaatctgattttgtgaaagtctgatatatccaagctctttgtatgtagtatttaaaagagttctgagtacttatgatgcaaaagaattctatgataatttttagtagcacattaatcaacttctgttggaactttttagcaaaaaaaaaaaaacctagatttcttttttgcttgatctgtatttgatttttataccaatgatcataggaaatgatcaaatgtgaatttaatgtaagttgggttctgaagctcacttgggttataacatttgcatttctctgtaaaattatagtaggcagtatgcactttcctacaacataattgttcatatgttattatggtatctttgtaaactagtaactttatcctagaacctcagggtggtatgtctgactagcacacacaattcatgggtttgtcattataggcctttcaaatatcaccttttcttcaagatggtccttgttttggactaaattgtatttctgcccccaaaatcctatgttgaaatctaacccccagtgcatcagaatgtggcttatttggagacagggtctttagaaggtaattaagtcaagtggggtcactggagatggagactctaatccagtatggctggtgtccttataaaaagaggaaatttagacacagagacaggcaagcacacaaggaagatgatgtgaagatacacggggaaaagacggtcgtctgcaaaccaaggaataccaaggattgctggcaaagaccagaaactgagggaagcaaagaccagaaactgagggaagtagtctcccctagagctgtccaagagagcatggctctttaggacatcttgattttggacttctcgcctccagaactgtaagacaatacatttctgttatttcaagccacccagtttatggtgctttgcaatagcggccttagggaactaaagtagtgccccccaaaaaatgacaaagaaggaataaacctcagtgagggacttttagcccaatccttcaatttccagtgatgtggcctaggggtgaggatagacttgcaaggccaaatagagacgctgggatccaggttctcaagcgtgtgtttctcctaggtgtataacttcacattaacttgtctacacttgtggatgtctcccatcacttataataaagctctttgtttgctttaagaaaaaaagaaaagaaagaaagaaagaaagaaaccaaaagaaagttacttcactcatgcctgaaaatacaaatgatttattgatttacttgctcttatttcttcccacttgatattaaatcacaaataaaagcatggtaatgttctcgcagagctatgtaaggacataatgttttaaatactgactggaatgaatatatattttgacattgataccagagaaatgttagtatcattttgattttcaataattcagatgttaggcttttagaacttttacatatacatttcttgggtatattcaaaattaataaggtcatatggttgccataagaaaatcatagctaaagtgatttaaaatgtaggagccacaattgatttaattacacgccaagaaatgaagaacaaaaatgatataaatgcttctaataggaaaagaaaactgtttttacagagttaaaccatcatcgagttaaacaagcacataacctatcttggtttggaccttcggagagtggactgatggcctgaagtgtgatctgaattgatggggcagagacattctatacacacagataaccggcctctcgtcttgcgaagttctccagtgcatagtcagagctagtgaccttactgagtagggtgactaagagtgtgacaaagggtgactctgcccatattttctctgtgtcttcccattgcgatgggtcattttaaagctgacaccaatctttaacccataagtaattctatattaaaaaaaaaaaccctggttacagcacatttaatagtgataattccacagtatgttaattatctggtctctctaaaataagtcactgtaaggggctccagcttttttcttatgatattaaataaatcagagaagaagaggttatcatgatggttcagagccactccaagtccagaaagagagaagtcccgaagagttataaggatttaacgaattggttgctcaaactctttggcagtagaaaggttgtgcaggaatctaaaggcagagagagactgaaactaatgaaagaagtgaaccataaaagtaagttttttcctcctagggtacttctccaaaatgcaattttcttagccccataccctagggtaattttgagactgatggtctgaaaccacattttgagagactcctttaagagctctttttattgtctttcaacccagcttcctcaaggtatggtggtcatgtatttaaattggtgcttaagaatatattcaattttagattcatagctcccccagctgattttaagatttgatttttccttttcatctagaggggctttttagtttcactatagtatgcttaatgtggatgtcttttaatatttttcagtactcaattgcagtataattgacgtgcaataaatggaacttggaaacatatgcttacacccgtgaaactgctaaacacagtatgacagttgaatagagacatcaccatccaaaaattctctggcccctttgtagtccctaccacctgccccacatgtgcccagacagttaccaatcttgtgattgttagtttttattttgtagaatttcatattaatgaaatcatacaaaatatactctttttatctaacttctttggctcagtttattcttttatattgctgagtaatattgattatcacttcacttattggtggacatttgaattgttcccagtttgggatattataaataaagcttcagtgaatatgtgtgtacaggtctttggccagacatgatttgatatcaattagtcaaacatctcaggcagaaaaaaatgggtcatttggcaaatgtatgtttaacttaaaaaaaaaaaaaaaaagccctgcccagtgattttacatttccagcagcaatgcatgagagttccaattcctctagatcctcaccaacacttggtatggtcagtttttaaattttgcacattctaataggtgaatagtagtagctccttattgtttgcctttgtgctcatcaaatgaataatgatattgagcatctttttatgtacctaattgccatctatatgtactctttggtaaagtttctctttaaattggtttgtggaaaaagttaacagttatctttatttttaaaatagactccatggttcattccttttagcttttcatttttctcattttattctgcagggatatggacacatctcctggatatggaacaggaaacttacattagaggattaaatctgattgcatggaaagcaagtcaggaactaaatggaaatgtttgtttgtttgttttgagacagaatttcactcttgtcgcccaggctggagtgcaatggtgcgtactcagctcactgcaacctccgcctctcggattcaagagattttcctgcctcagcctcctgagtagctgggactacaggtggcatcgcaaagtgctgggattacaggcatgagccactgcacccagctggaaactaggtctttaatgacattattcagttacctaactttcctgtgtaacccactgatggacatcaccctctaggaggtgaaaaatacttataaactgctattgtagatttgtatgttacctgtagaggaatgggtgagaaaaaaaaagtcaaatgaaaaatattcctatacgcctgtgctataattatatatggagggggatcttgttctctagagttcagtggcccaatcacagctcactgcagccttgaactcctgggcgcaagacatccttctgcttcagcctctctagtagctgggactacaggagcatgctactatgactgactaattttttttaattttttgtggaggcagagtctcactctctgttttccagggtggtcttgaactcctgggctcaggtaattctcttgccttggcctcccaaaatgctgagattacaggcatgagccactgtgccaggccatgtgctataaatactgtttgattttaatgaaacatctaattctctttctttttgttaaagagctattttcactaatttcctgcagtaggaagatcctcagctgaaaaaaattgctcagctctagataattattgcttctctgagatctatgtgaaaatgataaggatggtcctttaatagccatatctgcaccacattgagtgcccaattatagttgactgatagaaagtataaacctcccccagagttagaaaatctgtacttaggcttcatggtctttctaacccctacaaaaaaatttctatttaaaaaaaaaggagaatgtcacagttttcaaaacgtttgctgctcagtgtgtggactataacttgcagggagtaaatattatctgggaccttccaggaaagatggattcccaggttccagaaagacccacagatgtagaagattgtgtttaaccagaattccccgtgaattgtatagccatttaaataaaattaattaaataaaatcgacatttaaaagcagtactctaaagcacttcagtccttaattttagtctatatctgagttttagacctatatgtgccattgcattccatgaaccaactctgtgattttatactagacgttccttacaaaagtaataaatagcttatacatgcctccccacccggaattttttttttttttttgcttgttagctactatggatttttattacttacaaatcaagggcccttaataaatcagcttctcaaacaaaatttcctttagcactgtagcacaaatcttgaagtctggaagcaattactgtgcatatcaatgataatgacagatgttatacattggggttggcttacaatcatctgcaggttaattttattattttgattcatacttgggaaattcatattaatgaagattacctcaaaagagctgagtttcattttcctcaagaattcagataaagttaatgtaaatttttttttgaaatggcattttagaagaccaggtagccataattacataccttcttatccttataatcagtaggtataaaggctactgttataagagaaaagtaactactaaatattgaaataaaagagtaacttgcaatacatgattctggtagctacttgaataggattaggacacatctgtgcactcaaagaaaatgaaatattttaaagtgaattaaattacctttcagtaattcaagtagaaaaaaatctaacatgcaaggcaaaatctgcagaaatgtaagcataatacttttgcatagcaaattcttaaagctctttatgtgatattagcaaaaaggcagatacgctattcagggtactttatgaatgaaaaaaattgaaattaaccaaattatataattccatataataaatctaaaaatttatgagaatattttaatatgatttgcaccattttatttataggtttaatctttttaaaggaggtaacaaagagacattgaccacattctttccattatgatagtgatttttagtctaaagcaagttttatactttattctagaaaaacatcacaaggatgaagaaaaatcaatttgctttctgtggttgttcttctaaaatttaaggatactagcaagtttagaaaagaaagaattagtcaatttataaacaatcaatgttacatatacgtgtgtgtgtacacatgtgtgtggtgtgtatcagccaagaacaacatatgactacttgatttatgtctcgaaatatttcaaagttacattctataaatcattaattcttaatgtttgaacaatgagctagtgttcagtgacagaattctagaaagaatgacattgaagtgctgcttctcaaaactcaacttgtgaaataagaaaaaaataataatataatagaacagtctacagtgataccatcctgaacatgtctgatcttttctgatctcagaagctaagcaggattgggcctggttagtacttgtatgagagagtgcctaaaaataacacttgaagtcttgaaacaattactgtaaatatcagtgaatgaaggaatgaaaagacaagccactgactgaggggaaatatttgcaaagacatctgacaaataactgttatccaaactgtacaaaaactcttaaaattcaacattaaaaaacacacagccaataagcataggaaaaaaaaagctcaatattcactaatcattagataaatgcaaatcaaaaccataatgagctattatctcacaccagtcagaatgactattattaaaaattcaaaaaataacagatgctggtgagttgcagagtaaagggaacacttttatacattgctggtgggaatgtaaattagttcaaccattgtgaaaagcagtgtggcaatttctcaaagaacataaaacacaagtaccattcgacccagcaatcccattattgggtatataaccaaaggaatacaaattgttctaccaataaagacatattcatgtgtatgttcatggcagcactagtcacaatagcaaagacatggaatcaacctaaacgctcatccacagtagactggattaaaaaaatgtggtacatctacaacatagagtactacatagccatgaaaaagaatgagatcatgtcctttgcagcaacatggatggagctggaggccattatcttagagtgaactaacacagtaagagaaaagcaaataccacatgttctcacttacaagtgggagctagcactgagtacacatagacacaaaaagggaagaacaaacacccaaacagaggggcccacttgaaggtggagggcaggaagagggagaggattgaaaaaccacctattgggtactatgtttattatctgggtgataaaataatctgtacgccaaatccccatgacatgcaatttacctctgtaacaaacgtgcacatatacccctaaagctaagataaaagtaagaaaaaaaaccttcaattttttttttttttttttgagacagagtcttactctgttgcccaggctgggagtgcagtggcgcgatcttggctcactacaacctgtgcctcccgggttcaagcaattctcctgcctcagcctccccagtagctgggattacaggctggtgccaccatgcccagctaatctttgtatttttagtagaaacagggtttcaccaggttggccaggctggcctggaactcctgacctcaggtgatccgccctcctcagcctcaaagtgctgggattacaggcgtgagccactgcgtctggcccaaaaaccctcgatttttgatttttaaaagttccatatcttaatagaatcttcatcaaaaaatagatagaaatggcaaataagcatgtaaaaagatgctccatatcatatatcatcagagaaatgcaagttagcacaacactgaatggccagatagggtgattcacacctgtaatcccaacactttcagaggccgaggagggaggattgcttgaggccaggcacgagttcgagattagcctgggtaacacagggagaccctgtttctaccaaaaacaaacaaacaaaaaaataaaaaataaaagaagaagaagaagaaagaaaaatcccaatgaatgagacactattaaataactattagaatggtcaaaatccagaacactgatgacatcaaatgttggcaaggatgtagagcagtaggaacttttatttattgctggtgggaatgccatatgctgtagtcatgttggaagacagttcgatggtttcttacaaaactaaacacatttttaccatgcaatccagcaatcatggcttcttggtattttaacttcaaaaaaattaaaacttatgcccctacaaaaacttgcacaagcatgtttatagcatctttattctaattgccaaagtttgcaggcaactaaaatatctttcggtaggtaaatagataaataaaccatggcacagccaaaccatgaaatattatttaatgataaagatctatccaaccatgaaaaggcatggaagaaacttaaatgcactttattatgtgaaagaagtcaatgtaaaagtgctatatactatgattatgactatataacattttggaaaagacaaaactatagagacaaaaaaaacagtggttgtcaggacttagggggatggggaaggatgaataggcagagcatagaggatttggggtgtaaatgtacttagataatactatagtggtagacacgtgtgattatacatctgttcaagcccacggaatgtacaacaccaaggatgaatgctatggttaaccatggactttgagtgattatgatgtgtcaatgtaggctcatcaattgtaacaaattgggggatgttgataatagaggaggctatacacgtgctgcaacaatggggatatagagaagctccataccttcatctcaattttactgtaaactaaatctgttctaaaaaaaagtcttttatttaaaaattcaccaaattaaatgaaaaaaatgatattttggccattgttttctctatattgcagaatattagccttactgacaccttcagacaatgtaccaaaattaattccaggtagttgtgggactcaatgagaaaggtgaaacaatataggtgaatattctcatggtttggggaaagtgagactagcagcatttggcaatagccatcagaaaatggctttgataatccactttatcacatgtgcttttgatattatcaacattttaccttacttctattatttactcctattgatagtcttaggattttagttgctttatttttctaatttttggaggtggataattagattagtaattttcataatttgttaaaaataatttaagcctagaatttatcattaaatacagaattcatcatatccccccaattttgatgaagacattttcatttgtatttggtccagtattttaaaatccatatcaacatttttcttgtcccacattttatttagacatatcatttcttaatttaaaggcatgtagacatattactgatttttttgttattgatttataagtttatgttatgacagtcttagattatacactctacgataaccctttgatatttgttcagacttattttctggaccagcatataatcacttccatagaaattctgtgtatatttgaaaaacactattacaatctgaaattttaaggacagtgctctatgtctgcccactaggtgaaaatatttaaattatattgcttaaaacatctatatgcttaaattttgtttgctctgctaatctaacagttactaagaaggatatattaaacactgtccactttggttgtacatttgtcttaatttttcttcatgaggacattggtattcatgaatgaggcaacaaacctcattaggtgtctactgtatgttaagaaatttgttttctaaaaacagcttttttgatataaagaaagtatacttgcataaatctttattttcttaagttttaggattttgtttaaaatcttatgaaatcatatgtgaatatcttagtttggggagctatgactgaataccatagattgggtagcttattaaaacaaacaaacaaacaaacaaacaaaaaccagtaatttgtatctgacagttctccaggctgaaagtccaaggtcaagacactggcagatttggtgtctggtgagaacctgctttctggctcatagatgaccatcttcttgctgtgtggcagaacaggtgagagatctcttttgactgtcttacaagggaactaatcccatttatcaggattttgcagttatgacccaatcaccttccaaaagctccacctccaaatagcatcacattggggattaggtttcaacatatacatttgggggaatataaatatccagtctatggcagtatataattgtatgttgggatttaaatagaaatgtaaaatattggacagtaacagcatacaggtggggatcaagctgcatgggaataaggaaataacaccaggcaataacttaaatctttagggaacaaaatgaacagatttcgaaattgtaaataagattattataagctaaatgtttatgtccccctcccccccaaattaatatgttaaagcctccagagtaatgatatttgaaggtgaggtcttcaggagttaatcaggtcataatttggagccctctttaatgggattagtgcctttttaaaaaggtctgactgaggcaggagaatcacttgaacctgggggttgggaggttgcagtgagccaagattgcgccactgcactttggcctggcgacagagcgagactctgtctcaaaaaaaaaaaaaaaaaaaaaaaaaaaaaagaggcccgagggagcttgtttgctccttcttccatgtgcagacacaataagatggaaccatctataaatgggaaagcaagccctcatcaaacgcccaatctgctggtactaggatcttggactttccagtctccagagctgtgagaaataaatgttgtttaagccactcaatctatggcatttgcgttatagcagcccaaactgagtgacacaaaaattaatattaaagtgtataaacacttgctcttctttcttctcttaccttctttttaaaaagtcttttaaaatacttatttaaaagacaaacttttgtgaagttatagaaatgataatgtattgtttagtttgtaatatgtaggcttaatatgcataacaataatacttcaataaagggaggaaagggatagaactatataggagaaaatatttatctataactggaattaagttataagtctgaggttaattttgatgttaagatgtgtatagtaagccatatgacaaaagctgacaaaattcaaagaatataacttgaaaaactcttaaaggaattaaaatattacagtagaaacacccacttaataaaaaataatccactacaagaagaacagaaacagaaagatatagcacataataaaaaagcacaatagccaatgttattctgaccatattaataataatattaaaagtgaatggactgaataacataaaaaaagaggttatctatcagaaaatttgcatccaaatctgtgctatttacaggtgaaacaaattgaaagaaaaagaatggaaaaagcataccatgcacactgcaaccataaaagaactgcaattgctatattaacatcacacaagatagactttaaagcaaacaacatgttattaaagataaaaaggacatctcagaataagtgggtcactctaccatcaaaatttaacaattataaagatatatgcactttaaaatagagcaccaaattacataaagcaaaaactgacaatattaaagggagagatagatgattctaaaaataatagcttaagacaaaaatatgccacttttgacagccagacagaacatctagacaaaacctcaataattaaatagaaggttgaacaacagtctaaattcactagacctaacaggcatccatggaattcaccaaattagagcagaatacacattcttctcagaggcacatggactattctccaggatagaccagatactaagccatttactatacattacctctttaaaatataaaatttgataaattttaacaaacatatacatcctaatattcatatgaaatctcaagcaactctggtgaaaacaattctataacagcaaagttggagggttcatacttgccttctttaaaacttaaaataaaagcatagcaatgaaaacagtgcgatactggcaaaataaaaaaccaatggactagaatagagcccagaaagaaattccctcacacatggtcaaataatgttcaacagggtgccaaggtcattaaatgaggaaatggggaaaagacaatcttttcagcaaatagtgttaggaaagtagatatccacatgcaacatgatgaagtaggactcttaccttacatgatatacaaaaacttaagtcaaaatggattaaagacctaaacataagacataaaactattaaactattagaaaaaaaaataagagaaaaacttttgttattggattcggcacgacttattggatatgacatgaaaagcacaggtaacaaaagaatagatagatacatcaatttttttcaaaaataaaaacttggaaaattttaattattaatgttaattaatgataatttaatattattaataatatttaatattaataatagttattaatattgattctaactttttaatttttaatgcatcaatgggcaacatcaagagggtgaaaatgcaaaccatggaatgaaagaacatatttgcgagtcatataattggtagcccttatatccaaaatatataaacaaatcctacagttcaaccacaaagaaaaacaattcaaatataaaattgaacaagggctggaataagtatatcttcaaaaatttacaaaagacaaatgagtgtatgaagggaagctcaacatcaccaaccatcagggaaatgccggtcaaaaccacaatgagaatccactttgcaactattacgatggctattaatttttttgtaaaaaggaaattacaagtgttgtaacaaatatgtggcaaaattagcacccttgtgaattactgctaagaataccaaatagtgcagctactatggaaaaccatgtggcaattcctcaaaaaattaaacataaaatcaccatataacccagtaattccacttgtaggagatactccaaagatttgaaaacaggaaaccggaacagatatttgtacaccagtgctcacggtggcattagtcacattagcccagagttggaacaacacaaatgtgcattgacaagtcaataaaaaaaaaaaactatgttatatatttacaatataaatattactcagccttaaaaaagaattggaacctctgatcatactacaatatagatgaaccacgaaaatacagttcacccttgaacaccggtttgaactgcacagatctacttatatgtggctttttttccacctctgccacccccaagacagcaagaccaattcctcctttttttctcctcctcagcctgcttgacatgcagacagcaaggataaagagctctataatgatccatttacacttaatgaacagtaaatatattttctctttcttttaattttattttctctagctttactgtaagaatgcagtatataaaacatataaaacacaaaatctgtgttatttgacagtttatgttattggcaaggtttccaatccaaagtaggatattcatagttaagtttttgggacgtctaaagtgacacatgaattttagactgggcagggagtcaatgtccctaacatccgtgttgttcaagggtcaattgtatttatgctaatcaaaagtcaaacacaaaagagtaaatattgcataattccatttcatagaaacagaaagtatattagtggctgtcaaaggacccaggggtggagagaatgggggattatttcttaacgggtacaagatttcagtttcagacgataagaaagttctgaagatggatagtggtaaaagctgcaaaacattatgacaggccttaatgtacttaatgccattgaactacacacttaaaatatatgcatacccccatttaattctttattgtgcttcacatacactgcgtttttcacaaattgaaggtttgtggccaccctgttttgagcaagtctaccagtgccattttttttcaacaacatgtgttcacctcatgtttctgtgtcacatctgagaatacccacaatatttaaaactttttcatgatgattatttctgtagtgatggtctgaaatcaatgattttgacattgctattatgattgttttggattgccctgaatagcacacatataagacagtctcagattatcattatcatatgttatcaatgaagtatttttaaattaagataggtacattttttctttaaacaatactattacactcttaatagactacaacatggtgtaaacatgacttttacatagccaaaaaaaatctaattactttccttattgtgatatttgcttcactacagtggtctggaatggaatccacaatattgatggcagcagtggcctgtctgaggagccccgcccacttccgattttgtggggcaggagccctgcgctctctggaatagctgcagctgcccagccatgaacccgggcatgcctgtgctctgggggcggggagggggcgcgggggaggaagcttcctggtaagtgcctgctccagctacctggcctcctggcctcctcagctcccagcacccactctgattttggaacaaagttgtggccgagcctgggggctgggtgcagcgctgatattccagccccctactgtctccgccccctccggactttgggcactgaccagcatgggagagaggacaagggggtgctgagggtggctcagcgcaggcctgcaggcacccctctgcatgaacaacctgagcaccatgaaaagcggcaggaggcagacgcactcctgggtggaaagggtaggtcctccatgaaaatccactttcaagccaggggcagcttgaaagcctggcggccgggctccgaattcggctattcagggcagtctcaactccgactggagtgagaacttacggtgctttttctggcctgctcatggccacccatggaccaatcatcatccacttcctcccctctgaagcccaaaaaaactccggactcccaaactcaggcggacgttgggacgacctgccagcagatagaagctgcccaccccactcccctcctcacccctaagggcagagagctgcacagacccctggatgacctgcctgtggaaaggagttaaacacattgggtctcctgagagttgtactgtcacccataaagcacctctttgccttgctcattctctatttgtccacttacctcatccttcctggacatgggacaagaactagggaccagccatttgcggaactgaaagagctgcaacacaaacagggccgaaacgtgctccgccctccgtccctgctgctcctcatgttgtgagcacgagaaagagaggagttatggagagaagcccttcaaggagcccagacctgggagtcccctgagccaggggtgtaaggcaccaccgcatttcccagtgcctgcagtggaagccacttccggtatgcctggtccagccacagacttgcagggagctagagcccgccccagtacctggagctgtccaccccgcaggagccagtctgcctggctgtgcgtagtgaccagacgctgtgctcgctcgcgcatgcacctctctccgcctgcgcctggctctcccttggcaggtgtgggatctgggccagtagcaaaagcccagtgcagcccgccaggctgagttggcgaaaccagcccaggaggcccaagcaaaatctggccaaaggcaccaccggccacacaggtttccagctggtgaagtgacaccccaaggatcctgtgacaatatcttcaaggtatccttacaatttaaatggtaaattttgaccaagcatggtggctcatacctgtaatcccagcactttgggagatcagagcaggtggatcgcttgagcccatgagttcgagaccagcctgggcaacatggcgaaaccccgtctctactaaaaatacaaaaattagttgtgcgtgcctgtaatcccagctattccagaggctgagacacaagaatcgcttgaacatgggaggcagaggttgcagtgaactgagattgtgccactgcacaccaacttaggtgacagagcaagacttagtctccaaaaaaaggtaaattttaagttatgtatatttcactgggatgaaaaaatttaattataggcatataggcaactctttaatctgaaacaaagtaaaacaaacaaaaaccctgtaatagccgtatgaacatccctatgattttaattgttggattatagtagaggctagtttcccaaagttattgcttctttttcatgaaggcctaaatacaagttttttgtttgtttgttttttgttttttttttgtatgtataagaatcaggggaaacttttttcttttgatttactatcgtattatttaattttaacggtaaagtctataactgatcgtgttagctattttgcttcgagaatcaagaacaggttaaccattcatgggttttagtacatttgtatgatgtgttacatgtatttcttgacactaaaatttcttttgtttttattatcctattcagctatgactttttgtcatgtagtctttttgtaacatattttctttcctatttacagtttatgaaaagtatacatgttctgtttggtttacccccactccctggctcaattcatttcaaaatagagtgcagaataaattgcacattattttttccatttattcttagactccctaaagtgctttgcacataggatgtagaaagcactcaaatgtatattgaattgattatttgtgaagattacaatgaagaggcagattggtccaagacgtataataaaacccaggggctatattttcctgacatcaatgtttactctaccaaatagaggtataaaaatgatgacagtggcctttcaactattatttttttgggtcctaaacacttcaaagtttcacacttctaaagaaaaaaaatttgattattttttagatagtaaggttaatattaatgttttgattattgtttacattgtttacacatttcttgtgcagggatattatcactataatacatctgtgataataatgattcaaacaatttgaaacataagatgattgaaatttcaggcaaaatcaaaatagagaaaaacctagtaaggcctcttttgtgacttctttatttaaaaaatttaaaatatataaggaatataatcacttctcagttctttaaaacttagtataagattttcttaatgccaagacagttaatgaatttttggacagattgattaaagaaatggcattaccaaccaaaattgcccttttaatgataaattccttcagctttgaattatacgttatgttccataattctgatgatcttaaggagacattcattttaaacttaattatttgataagattagaaataaaatattaatatgcatctccaagatacttcttttttattatctattaaaaatgttctctgttactatatacttacaggggaaaatattgaaagtggtctttagaacacagtacattaaagctcagtaacttaaaactggggtggctttttgcatttcacaattagtatttaatatttttccagaattagaaatattaaagattctttgcctaggaaaacatatactttgtctttctctattccctctgataatatctttcttaaccatatttcctcaaatcttagagacatcttaactaatgatattgtgaaaagtgtgaaaatacttgtcactagtcattagaatcattaattttcagatgatttcacagtaacatcctcatcatcattttttggagggtaggggagacagggtctcaatctgtcaccccggctggagtgcattagcataatcttggctcactgcaacctccacctcctgggctcaagtgattctcccacctcagcctccagagtagctaggatcacagattaggtgacaggtgtgtgccaccatgccaggttaatttttgtattttttgtagagatgggtcttgccctgtttcccaggctggtctcatcatcatttttatataataatgtcatcattgcaattttagtttttaaccataaagctttcaaaatgcaatggacaattgatataaatttatgttttatatgaacaaatcctataacacaatcttaatagtaaatccaaatttaaatcctcatttaagtagtggagaaagagcttaatttacacagtgggcaaatttaataattttaattcttatcttctaaattttgaatcaacatatctatcccatatgtaatctcacttcaaatagaacatctaaattaaaattaggagtaaaaacaaccagaacagagataaatgcatagttgaaatactgggataatagcaaacattgtagcttctttaggaagagggtaaactactagaatgttgttaaaatacacatctgcctttcaaaaaggagaaatttaaaataagagaaatatttcatttgataatactgtctagccaagatattacatggccaatggaagaaatttcaacgtgagtaacagctcttgccttaagtagcttaggatgtattaagaaaaattgctgttactgctgctattacataggatgattgaaatcacacatgtggtggctatgtggcatggggaaaaacttttgagctttgaagcaacatagaactgattttaagacctggtgccatactttatcagttggacagtccatgacccatcacttatactctccgtgtctcaaattccatcctggtggttggaggtgattataccttcagagggtttctgtgaagattagaaatgatttgatattcctgggactcatagaagttagcttgtggaagtcttaataagttgcaccatggtgggtgggaggtttgggagaaatcaagaaaactttttggagggatgtgtttttttagaagaggcttgacagacagtttttgttagagaaggagttgaacatttcttgtgcagagcacacgaaagaagcaatgatgggtgatagtggaggcgggtgcagtttggggtgtaaataaggaaaatggaaaacgatctgagagtgtggatggcaccagagaaggggagagttaaaatcatttatcatagaaggcgagccaggggtgatttaaaaagaagtagatatattttagccaaagcatggcactgagttttagttttagaacattgttgacaaacgtccagggtaatgaggaaggaggaattggcctaaagggtcctccatggggagtgcttgaaagcagtataaaccgagcaagtgctgtttatgtgggggatcctctcttttctacctaccttttctgcttccacccatctcacatgcaattttgtacagacatttctctgttcttgtttccacctgtctgcctcctgaagatggattttcacctcagaagatagtgattctattaaatctacatcagatcaggccactctgctgcccacaatgctctagcagcttctcatgatattcagagtaaaagccaaaatcctgacaataaactaaaagcttcaaaatatgtggcaccttgttatttatctgacattatttctactttctccattgccccagcctctcactggtctcatcagtttttcttaaacttgtgaagcaagcttccttcacagggactctgctgtggtcattccgtctgtctggaatgttctctcagtagacacatggatcactcgcttgctttaagttgtcagttaaacaacaatgaaggtttttgttattttctctcagaactatttaagattctcttcttcaacacttattttttcaaaatttatttttgcttttagcatttatctcagtctaacttcctcttcatttttatattattaatatttctctcatttattgtctgtctttcttacaaaataggtttataaatgcagggagctttgtctgttttgttcgctgttacatttaaaatgtctggcatattgtggcactcaatgaataaatactcttcaagtgactacatgaatgaactagggaatggaagtttcaagagaaagaggaggtaagttttaaaacgtgacaaagccgagcacggtagctcaggcttcaatctcagcactttgggaggctgaggcagatggaacatttgaggtcaggagttcaaggccagcctggccaacatggtgagaccccatctctactaaaatacaaaaattaactaagcatggtggcacatgcctgtaatcccagctactcgagaggctgtgacaggagaattgcttgaacctggaagacggaggctgcagtgagccaagaacatgctactaccctccagcctaggtgacagagtgagagactccgtctcaaaaaaaaagaaagtgacaaagctacatatactctgtaaaaatgaatgatcacatgaatgaatttgcaaccgcacagaaataaataaatataaagaatatttaaatttataaaaaaattattatttgactaccaaatgtgtgatactgttaggcattggaaaatcaaagtccttcccattccatcagttaatttattttaaaaagataaatgttatttgtttaggtaaattttcaatctagagatatagcactttaagcaaaatataatcatttgctgaataatattttgaattattttatgacactgagataatgagtgttaaaataatgtgatctaatttcccaagtaagaataaacttttatctattatctgtctatctatcatctctttattcatggaatttgaaaatatgaaggaatctatcatataaaaacgaaattacatctgttttaatgaacaagatccctagttattgatcaagtaatgtaatcaaaaacccaagtaaatattttaagttatttggaataaaattcttttcaaaaagtcctttaattatgaaagatgaacaggattggaaatgaatactattctaatttacatcaaaaatgcaaacaggcatttattataatcatactcagattcacacctacaaatttaagttatacatagtacatggcaaattagataaacacatttattcatgtttaaaatagtgtaatgccaccaccaaggaagccagtaaaaaagtaccccaagaatatactaaaggaaatgaagagcctcttttcaacttattcaagtgccgacaatggagtagggagaagaattggtagaagagatgggcaagcatcactatggagctggctcagtgacatgtgctttgtcatactagaaagattgattttatctttttacttcacaaattaggaaaatagggttttttttttcccattaaagaaacagatatataaaggaatagatatgaaaatctatttacgtgtttgaaatagactcagagtgtttatgagatttttccaaatggaatagggctgaatagagtacaaggaatattggcttaacctctctttctgttaaaggatcttcactggaaatatttgagaggcacttgtttaagagactgagatactagtgttttacatttttaaatgtatatatttaaaattaattagtgatagggtttggctctgtgtccctacccaaatctcatatcaaattgtaattcccaatgttagaagagggaccgcgtgggaggtgattggatcatgggattggatttcccctcttgctgttcccatgatagtgagtgagctctcacaagttctggttgtttaaaggtgtgtagcacttcccctttccctcactctcctgctgccatgtgaagataagctggcttcctcttccccttctgccatgattgtaaatttcctgaggcctcccagccatacttactgtacaggctgtagaatcatgagcctattaaacctcttttctttataagttacacagtatcagctaggtctttatagcaatgtgagaatgaactaatacaattagtaattaaacaattattggtcaactaatttattcactaatactgtaggcagccaccgtacaagaaaaagagaaatgaatagaatttatacaatcttcgcccatatggagcttgtgctcatattgctgtgcttctgagagtttttattaagaaacaaagatattctaacacaattaaacacagcacaatatttaaaaacaaagagtttaaaaattttcaaattcactagttcattagtaacctattttaccaaaaatataagaaaataatgtttaaagataaataggcatctcaaggtattcacagatttaagtgggttacgactttttaaaagaaaacattttaaatacatataaaagagtaaaaaaagtaaaagaaagaacagtgtgattaagacaatgtttatagaagacaatataggtaagaaacacaggggaagaaagaagaattaagaacaaagtcttggagaaaaagtcctggcatcatcactcactgcaacctgactattagttactattttattcagtgtataattatatctacaagataagagtaggtaagagaatgacaaattctcctagaaaaaaaacattgaaacaaaatacattttaggaaaattatgagatctcaaaaacctagagaaattgaaaaaaaagtcctagggaaatgcagtttttcaaaactaattgcactggagatagaaagcaagatggcatcatagaggaatatatcaaacctcaaacaccagatagtctcaatgcaccatagattatttcctaggatagccctgattcccaaacctgataaagacagtacaaagaaaaaataatttagactaatagatttgcaaacactgtggcaaaaatttcccctgtaaagttaattaataaaatctgatactacattaagacaacgacataagtggatcaagtaaaaatttctccatgaattcaaggttgcttcagtatgatgatatctatttatattaagcactgtatattaatagtacacactacagccttgcaagattccagtcacagccctgtggctccagttggacctgtcctttgaaacatgtggagacggttatgcactccaggcctgtgcactccaggcctgtgatcagcctgtgatgggagtgacagtcctgagaatctctgaattgcctttagtgtcactcttctattgtcttgaaaaatagctcctggcttctatactattctccttatcaaataatcacctggccttcaccttagagttctaattttctacaatgtggataggctgagacttttccaactctttatgttcctctttctttttgcttatcgactctgtctttaaatcatttctctcttctcacattttaatataagcattcagaaggagccaagccaggccttcaacattttgcttagaaatcttttcagctaaatattgaattattcaatcactcacaagtttgaccttccataaaacactagaacatgaacacaattcagccaagttcattgtcactttattacaaagatggtcttttctccattgttcaataatgttcctttttattgagacctcaaccaaatggcttctaccattcatatttctacaacattctgttcatggttatttaagtattcttaagaaaatgacagcttcctctacagctttctgatttctttctgtgccctaactggagtcacctttaaaggtgtgttcacaacaatgtaagatttttaggctgtacctcaatattccttcaacctcttcctattacccagttacaaagctgagtacacaattttaggtatctgttacagcagcatacggctcctgttatcaactttctgccttagtccattctggctgctataacagtaatatcacagactggatagcttaaggaacaaatatttatattttacagttgtggaggctgggaagtccaagatgaagatacaagccaatttcgtgtcagatgggagcctgcttcctagtttatagatagctttcttctcactgtgttctcacatagtaaaaggggtgaaagaataccctggagtctcttataagggtgctaatcctattcataaggtttctgctctcttacctaacttcctcccaaaggctgcaactcctaataccatcacattgggttagaatttcaacatatgaattttagagataaagatttactctataacaggagtgttcaaaaaatattggtaacatgtcaaaagaacaccgaagttgattaaatgtgtttttattgatcagatactacacaattgaacatgagtccatactactataaatacatatattatatatacatgaatgaaaagggtggaaggaaaaggttgttcttacggtggaaagccaactaatacatgtagaaaacataatagaaaataaccagtaccagtcatcacaataacagattcaacaagaaacaccaataaattatatactagtgggtagacgtttaaagagtaacaagatatttactttactcagcatatcttctcacaatactaattgactagaaaagggtaaatagtaaataacagtgaagaaacctggtaggcattatcttaatcaagtgatcaaagttattaggctagacaacaatgtgactgatcagtagcatactctgcagtaatagaacactgagaaggattcagcatcaattctgcgatatttctgccaaaagtccataacctgaattaatcatgaagcagtactataaaaattgagagatggtctacaaaacaactggccagtcctcctaaaaattttcaagtaataaataacaaaagtcactcagcaaatttttcagattaaagaatgtcttagttcatttgtgttgctatgagagaataaccgaggctgggtaacgtataaaggaaagagttttatttagctcatggttttgctgtatgtataaaaagcatggtgttcccttccgttccacttctgtgagggcttttgtgctgtgtcaaaacatggcagagaagggtaaagggtaagcatgtgcaaaaaggagaaagcctgagggatgtcctgagtttataaccacccactatcataggaacaaatctagttttataggaactcactgacaaacgtgagaatacctccacatcattcatgagggacttttccccccacaacctaaacaccttccaattgacctcaccttccaatactctgacattgaggatcacattcaacataagatttcatagggacaaatgaactatatccaaagcatagcaaagagacatatgagacatcataaataaatgtaatccatgatgtgaattttccttttgctataaaaatattgttccattaattggtgaagttgaaataaaatcagtagattacataatagtagtatgtcaatatatatttcctgattttgataattttactatggaactgttagaaaatttctttatttagaaaatatccattgtactcactgatatatttacaaataaaagggtcttatcaactggtaattaagaaccatgtgtatatgtacatatatataaacacagacacataggagaaacagaataaaataactgtagtaatatactgaaatttgtggaatctgtgtgaagggcatctagaagttctttgtgttgctcttataatttgctggtaagtttgaaacaatggcagaattaacacttaaaaaaacaaacaaactttataatatagatgttacccatttttttaaaaaataagaaaactaagatcagatagtacaaatgcccaataatgcaaaggaagtactgatctattacgcagtaaataaaagcctccactgtaaataacaatagttttaataatattaaccctaacaaccttatgttgcctagcacatctcctcaaccaacagacctaactctacaatgaataggaaatgcaaggaaataaagtagcgtactccactccttttagaatcttcaacctagacaattaatttaaaaaattattatggaggtaacaccaggctagcatgtgtgtatgcatgggtggagatgagagggcataataccgggtttggtttagcgtatttattgttagaaattgaaagagagaaaataagtttccttttccctcttaggttctcaggttgagcctgaaaagtaaacttacaaagacagaataacgggaaaaaagaaaacaagtttatttttacatgttcattgaggccttcatataaaacaaatgaagtcccccaaaagcagataggcttcaaagattatataccagtttaacaaaggggacttgaagtggagcgagatggcagaatagaagggaagattccacgaatcatctcctgagcaaggacaccaatttatcaactatctacacacaaaaaacaccttaatgagaaccaaagatcaggtgagcattcccggtacctggtttaactttgtattgctaaaagatccactgaataggtagaaataacaatattgaattttcagtgccacccatcccctgccctggcagtggtggcatggtgtggatagcgtttctatgtgctgatgaaaggagagcacagcgattgtgaggcactgaactcagtgtggtcctgctacagcacaaaagaaaaccagaccaatctcagctgaagagtaaatcaggaagaaatccaaaacctgaagagaccaatgacaagtaacaagatagaagctgtaataaaaagtctccccttaaagaaaagcctgggaggccttttattgcagtttgatagctttactgttaaattctaccaaacacttaggaagaactaataccaatcctactcaaattatctggaaaaatagagaaggaaagaatactcccaaactcattctacgaggccagtattacactgatactaaaaccaaatgaagagacatcaaaaaaggaaaattacaggccaatacctccaatgaatatgaatgcaaaacttctcagcaaaatactagcaaaccaaattcaacaatacattagaaagatgactctttatgaccaagtaggatttatccctgggatgcaaggatggttaaacatatgcgaataaatcagtgttacatcatatgaacagactgaaagataaaaattatgtgatcgtttcaattgatcctacaaaagcatttgatataattcaacatcccttcatgacaaaaatcctcaaaaacttaggagagaaggaacatacctcaacgtaataaaagccatatacaaaagacccactgctagtatcatagtgaatgggaaaaaaactgaaagcatttcctctaaaatctggaacatgataaggatgtctgctgtcatcactattttttcacatagtactggaagtcctagctagaacagacaagagaataaataaagcgtaatcaaattggaaaggaagaagtcaaactatccttgtttgcaaataatattatctgactgactgaaagtccaccaaaaaactgttagaactgacaaacaaaatcagtagttacaggaccaaaattaacattcaaaaattagtagcatttctatatgccaacagtaaacaatctgaaaaaatgttttaagtaaatcccatttataatagatacagataaagttaaatgcctaggaattaaattatccaaagaagtgaaattttcctatcgtgaaagctatgaaacactgatgaaagaaattgagatgaaagaaattgaagaggccaccaaaaaattgaacgatattccatgttcatcattggaagaatcgatgttgttaaaatgtccatactacccaaagcaatctacatatttaatgcaattcctatctaaataccaatggcattcttcacagaaattgaaaaaaatcctaaaatttatatggaaccacaaaagacccagaatagccaaagcaatcctaagcaaaaagaacaaaactgaagaattttattacctgaattcaaattatactacggaggtatagtaagcaaaacagcacagtattgacataaaacagacacatagaccaatggaacagaattgagaacccataaacaaattcacacacctacagtgaactcatttttgaccaagctgccaggaacatacactggggaaaggactgtttcttcaatagacggtgctaggaaaactgggtatccatatgcagtagaaggaaaagagacctctatctctcaccatatagaaaaatcagatcaaaatggattaatgacttaaatctaagatctcaaaatgtgaaactattacaagaaaacattatagaaaatctccaggacattggtctgggtaaaaatttcttgagcaataccccataagcacagtcaatcaaagtaaaaatggacaaatgagatcacatcaagttaaaaagcttctgcacggcagaatgggggaaaatatttgcaaactttccattcaacaaggtattaataaccagaaaatataaggagcttaaatcactctaggggaaaaaaaatcaaataatctgatcaaaaaatgggcataagatttcgatagtcatttctcaaaaaaagacatacacatggcaaacaggcataggaaaaggtgctgggcattactgatcatcagagaaatgcatatcaaaactacaatgagacattatctcatgccagtctacatggcttagatccaaaagacagccaataacaaatgctggcaaggatgtggagaaaagggaacacttgtacactgttgatgggactgtaaattagcaggaccatgatagaaaacagtttttaggttccacaaaaaactaaaaacagagttaccatatgattcagcaattcccctgctgtgtatatatccaaaagaaaggaaatcagtgtatcaaagagatacctgcacttccatgtttgttggagcactgttcacaatagccaagatttggaagcaacttaagtgtccacactattgagtcagagaaaagaatgggatccagtcatttgcaccaatatggatggaattggaagtcattaggttaagtgaaataagccaggcatagaaagacaaaacttatgttctcacttgtttgtggaatctaaaaatcaaaacaattgaattcctgaagatagtagaaggatggttaccagaagctgggaaatgtggttgaggtcgggggaaggtggggatggttaatgggcacaaaaaaattgttacaaagaataaataaggcctactatttgatagtaccataggctgacaatagtcaaaaataattgtacattttaaaataactaaaacagtgtaattggattgtttataacacgaagaataaatgtttgagggaatgggtactccatctttatgatgtgattattcacctgtgatttgcatgcctgtgtatacacctgctttttacttacacaatttagaaattaaaaaaaaattaaaaagcaaggtatgatgaattgggaagatgtgacaagacaaaaaagtgggaaggggacttggggtggttaactgtgagaaagtgactaatggaagatagggttgttttagtaggtcggtttttgtaaattcatcttggtgtctcctccctgactccagtaataagaacattttttgcctggtgatgggagaagggagacgtttttcatgggaaatgtgatgcctttcttttaggtagaaaggaagggttcagagaggccttcctacatctgcgttttctcaactgctttcagctctaaggaatcaatatgccaaggtggcatattttgagcttgcatgttttcatccccttcaaagcacagaagcaaatataccgaccacttccacttagtatagaaactttttcctctaatttggaacttgttccatcttttgcttttttgtttgcttattctgatcttagtgttcctctctgtatttattcttctattatttttaatgtattttattttcactctaccttcctatgatttgtgaagaaaaattaatacaaaatctacacaattcagacaatagtcatgtctacaactgttctcagttcaggcagaaagtttttggtaaccaactatttatttatgctaaaagtcaactgtacatgcccaaataataacggaatcatttggaaaatttaaagaacaaatattaaatattcaagtttttggtttgtaaattaaggagtactgtaaatcttcccagtagctaataaaaggagaaataaatacatttgattaatcttattttcaaatgattaaacaagtaaagcttattttccttaagatatttaggtatatttaagaatatatatacttaaaactatatatataaaatatgtagtttgtgtgatcaagaaagttacattttatttctgtaactattcaccatagaatgccagggggcatagtaccataattaggttaaaatgtaatgttatgtgtaaacataacggatacataatggcacgactaagcaaatcaatatcatggacatttctctgaaaacaagaaaaatctatttagaacaaataatagttgttataaagacttgtatcacaagtaattcaaaataatcacattaattaaaagtgtgaactgggtgcagtggcacatgcctgtaatgccagccctttgggaggctaaggaaggaggattgctggagcccaggagtttgagactaacctaggcaacgttgtgataccttctgtctacaaaagccgggcacagtggtaagtgtctgtagtgccagctacttggaggactgaggtaggaggatggcttgaggccaggagttcaaggcggcagtgagctatgatcacagcactgtattccagcctgggtgacagagcaagatcctgtctttaaaaaaaaaataaataaatgaaatgtttaaagtgcaactaaaatttactgtagaaaaatattgaatagctgagtaattatgcttatacatgcaaaaatcatggatgcatacctctgcattaatattttttgtcaatcaagcagcaagaatgtttattactgatatgtcacatcactgaacggtcatcagcaggagataaagtctgggttttttcccagaaacaatttatcaataatgtttgtgccagttgcctttttgtattgtccccctaaacacatacaaatggtattttctcttcaatgttgtatatgaaatgtctcacgtgtatattcttcagtttgtgttttcacatggaaaacatattcaaaagtttacgtttgaaggtgggtatggtggtacacacttgtagtcccagcttcttgggaggctgaggcaggaggatctcttgagtctgggagtttgaggctgcagtgagctatgactgtgacactgcactccagcctgggtgccagactcagaccctgtctctaaagttattaaataaataaagaaagatttttttaaaagaaaaatgtgaaggtttacatgtgaagctaaacattttaattacaaacgaatggattttctttgcttggagatctttacagtttgagtaattgcaaaagtatactgtgctatggtcctcattcttctcaaacaagtctaataacctctacctcacatcacccatcttatagtgagatgagcatataatttcttatctacacctggacacttttaataacagcggcattaattaaactatgacagcataagccaggaatctcacaggcaaatccagaaaatggtcaaatctatatattcctacaaatatataccatttaaggatgaagaaaagagtgattgtgcagaagtattgagcaggcactaaggaaatggcagagaggggaacacagccttggaatacaggtggcttatatttttcacaggtcactctgtatatgagcatcaaattgtgaatagtgttatccaactgaaaataaaagtagacatcatctggggtaaatgaataaagagcaactttacaaaaacttcagagtaagcttgagagaaatatgcagcaattttgcagaaagataggattacacctttctcaccaattattagtaccatctggcattattaaacttaattgcaaactcatgccacaccaatttttgtctgtttaattttactaggttctctctcataggcctcttttagtagcctgcataaaccacatccaagcaattctagcaggttctgtctctcattttctttgtgacttatagttgcatcaattcaggctaagtaaaatgcaatattgaaggcattgatttcttaactatctatgaaatggaaatctatgggaaggaaaaatagatttgagtttattacagtcaggatggcacttttctctatattgacaagtgcatcacatgatttagttaaaacaatagaagctacaaaaaaaagcattcatttgaaggattccaattagattgcagtacttatgaaatagcaaaacacaagatcaaatccgaggtagagttgaggcaaatttaggtatctcagcaagatgaaaaacaaaaaccttcttactaaaatttgtcatgagttgactcaagtcaaagtgactttttagatttatatattcgtggaatctagaattttattgacctagtatggatcatgagtccactgatttgaacttcttttgcataatattatgactgctgtccccgtgacaatcacattcattgtaggagtattaatttccaaagtatgggcatataaatgaaggataaaagcactgtgggcagataatgtatagtatagttattctatactatgacacttaatcctgtacattgatagcctgaaaactgatgaagacctcaaacaatcatagttgggtacaatatgtatatcttaacataagaaaatctcttatactgttattcatggatccctttctagaactcaaatccattctctcaccaataatacatacaattaaaatagcacacccaatgccacagatgctaaaggaatgtctgcccataaagttatctttgtatagagttcatacctgattttatatttttgctaaagtaaatatatttttggtaaagtcaggtttatgaaccacttgtgaaaattatcaacggtcaagttgatgattttatattttaaaagaaaatattttgaattttgtgtttttttatgctaatatagaatagtttattgacatttattttcaattttaataaaattctctctttttctaatgctttaaatacacatttatttaaacaaatttaaaaatattctaaaaataaattaaacgatgtatgactagctttccagacaagagtaactcttctacattctagttgggtgtcttcacgatgtagatcagacatctccgtggtttatttatttttctaggaatattattttttatataaccccctaattatatgaacacatggaataattgtaggtctttcatctttaatattatttttaaagtgctatatgctcccttctgtcattcttggttatatatggaaagaagataagaattttttggtaagaataaataagtaacataaatgaattctatgttgtttacctgaatgagaccttctgaaatatctctggatcatatgagcttgaaaagacatattggaaaataatttctataatacatcaatgagttttgctgctattgttcctgttgctattaaaacagagttaagtagtcaattacattcctctctgttttctctatatcttttattacttcaaatgatgaaatatgtaagatattaaagtaacaaaaataacacattaaattcaggtcaaataaaagataaggatttctttctataggcagctttacaaataagaatttataaatgttaatatttttgttttttagaaaagtgacttggtataaagattgaaaaagctcagatttatattgtttgtagtaactttttagactgttggccatttcagaggaaaaacacaggcgattgtcaaatttctttttttttttcttcaggaagtattatcttgaatgttttcttaacaatatgagaaataaatgacaaattctatacatagatgtcacattttaaatctgacaaatttcaaacatttaatttcccatgttactaacatattagaaaagaatataaactagggattattagataattctgtgaaatgaactattatagctaagtggagcatattgattatctttaagtttaataatatcatagaacaatttattatgcagaaatattagataaatgtattatcatctaaggtaaatcaggtttgcttaatcatgttctattataggaataatgttgatataattaaaagtatccactaagcagcacaaggaaattgatcaacaaaatacatcttgattaatttctaagtctaccatttaccaaatctgttattttaagcaggttatgtgactctgatttttgatctgcaggtttttttggctatgaaataatgaaatggagttataatacacaatgaatgtggttgttctgagaattaaatgtaacactgcacatgaaaccctatgccgagagccttgcctgaagtaattccttaatatatgagacctattgttattattattaacatgatgatatttaaatattgcgttcgaaaaaccaagaaaatctatgtataaaatggacagaagcagcagttttttttaatgagagaatatgcttctcttgctatatcattttcctatataggagttttgctcttttatctagacatgtaattaaagccatcaattattcctaaaaagtttcctatggatagaacacctttacttttaatcatcctggtgatgtctcttttgtatgaaatgaaattcctagcattacatatggaaatgtgagaatctcagatttatatactcaatatcaagataaaattacctccccaaactgcatttacttcaaagcattattactagggttccatgaagcaatgtcagcacatggtctggccttcagtttcaaggattataaaacagagaacctattaggaagaataccaacatagcaacttatacgccttactgcatgagaattagtttttaaaaacccacgtattcaatctgtggcctagtctccgattaagaatgtgatagaagagccaacgctgacgaaagaacagtgcatactcctggttatgagaagaagaacaatgcattgtttctgtattacagggtggtactttccagaaaaggattgaagtaatttgaaggggaaaagcttgagaaactcctacttttatcttcctgggagggttcttttatccttgagtattttgagggatcatactagaactcagataggaaagagagagagagagaatgagctaaaagtgaatcttcagttttcatgataagttatttttatctctcctctgtaagtacagatatgggaaggaattcacatcagaaatctttactgggaattaagtgaatgggattgactggagtaacccgtgtctttaatgtcttcataaactgttgggtgactgtgacaagaacatgagaaccctatgcagttagtaacaaagacaaatagtgtctgcaagtaaattattcaaggtgaatatactgtaaataaatgaaatgcatatgattaaagtttaagtaattagcttattaattgatagcagtacagtgaattcagtcacagtcaagtaattggataaagggaatggttgaaatgaccaaaatgactacgccctattgcttactagttctgtgaatatagccatggtttaaggtctaagaaagaatcaaacaaactctcttggcaagtatgttaaggttaattgttttcctagctgtgcaatcttgggtagattgttttggtaccgtttgcctcactttggagtaaaataaagaacaacttccacacaatgttgatgtgaatattgaataagaaaaatatttacagagacatattgggttttcaatatgtgattttgttttccctatttatttttctttcttctctaagcagaaatggcatatctcataaggcagaattttttctgatgtcgctataaatatttatatttttcttcattaccatttcattagaaaaaatattgtgagcaactttcacacaaacacctggggatgcagcagtgaagaaaacctgcaagggtctgtcatcagggagactacatataaaacactctgcaaacatttgttttatgcttttatctttataattgatatcacttggatttttttttttgcctttgaaaacagccttactattcccaggcaggccatacatcgtacaactagactcacatgtgggtttgcaccttttgatcttttaagctatttgtgaattaatattcttcatttttatcagtaatatcaaatacagacatagaacatataaatagtataggcctaaaagctaaattttgatctctaatttaaagtgaaagatatattaaatataaaatagtgaagtaaaatgttttggaatatagtatctcacagattaaaaagctttgttaatgcctctgaggttaattgcatattgaacctagtaaattatcttaatatctcattttcatatagaacccttgataaacttgattacctaaagttgtctgatgctggttaaatacttcaaggcaaacgaataactaaaacaatactttttttctttgtaactccatttgaaaggtaaaattgagtgtaattaaacccgatatggtctacttgttttatatttattcacataggttgggattttcatgcttaagcttgttagctttggaatgcctaggatggaacataatttgcagagttacactccagcagtcaacaaacaatggatctcctaaaactgtccttgcgtctacagtagcatttcttaattatatatttggcacggagaacaaatgaattgcccttagaaactaagtggattataaattgttaagtctacatttcaggcagcaatgcccataaaatgatgtgaaaattatcaatgctaaagccctttcataataataaagaaatcaatctaacttttaagtatcatcgtgcatattttattgtcatgaattccagtgatttgtgaagcagagcctgtgggtgggtacagactccactcctgtctgtgactgctggggattctaaactgtcttgctagtccactctcagcttttagcataagctgaaaacttgcataaaattctttgtaacatctggtatacctcccgggctctcttccttgtgtgcgctgccagggatgtgtccctgttcttatcccatcactttgaagtgacttaccttgtaaatgttatggtatttcactgtcttgtgtatgacttcaactttctgatgtattcaataaaagatttctggttttcattttagtttattcagctttagcttcttgttaggttgtatctttacaagttttctacatcttatgtataagcaaaacattctctgctgctttaagctgtcttttttgctgatcaactttatatttaattgcctgagatttaattcaaaaacatattatgactaaactagaggagaagcaaacatcctctccagaagaacagtttcaaatatccccttgaaaacgccgagtaaaatattgtatttaagtgaacatttttcattattttgttgtgaacacattatttcttgccatgaggagtagaaggatgtgtttgggcactgaataacccaaagaactgtctatggtagatcaggttacttggcaacccatctccatcattactctttcttgtgtccatgtgtgaatggcagagattgcaaaggtacaaatgaaaattttgagagtcgtttacagctaagattctgcaagtgaattatttccgttggaaatacttaatgtaataacggaagcattttctaacttttggagagatggaagcttagaagatggccagtctcattattacagtgctgaaccatcagctttttagacaagaagtggttgcaataatagcggggataagaaaatatttgttatttctttatatgaagatgtctttcagaaacaagtaatctagctgtggcggcctgactccaaatcattcagaaaggtgattacaaaattcagcaatttgtaatcacctaattttctggattaaatgcctccctgattgaatacacagaatgagttctgtttttttcttttctttttttcttttcttttttctttttttttttgagatggagtctcactttgtagcccagactggagtgcagtggcatgatctcagctcactgcaacctctgtctcccaggttcaagcggttctcctgcttgagcctcccaagtagctgggattacaggtgcacaccaccgtgactggctaatttttgtatttttagtagagacagggtttcaccatattggccaggctggtcttgaactccagaccttgtgatctgcccacctcggcctcccaaagtgctgggattacaggcgtgagccaccgctcccggctgagttttattttctttagaacatcctaacttaaaggaaatagaagccaagtctgagaaaagctgatttatctgtggagaatagtttctctaaatgtaagaatgaaagattatttgaatgtgaaacctaaagagcacaggaaaactaagatgtcacttgactagcttgaatacattaatgtcctacaaagggtatattggatataagactacagagaaattttgcagataaagtaatatttttgtgattcttctctaatcatgaaagagatctgctgcttgctatagtaaaacatagaagaatatttttcttttaatttctaccaatttttcagtgaatatgtttcctcataattgtttcaaatttcgtttaaatttaaccaatactttgtcttacttttaaatggtatgcttttacttttaggtattgcttttagatgtcttgtgttttcttttttaaaatatttcatttgactgttggtaaacaattgatagctttaagactgatagaagaaaagaagaaccaacattttatttcttaaattttttaaataaatagattaggttagaaatctgttactcgggttaaatgctttgcttaatgtccctcaactagtaaactatggggataggatctatttgcctttattgcccatgggttttcacgtatatgcctatattgcaacagcattttttgttaaagaagtgatgatctttttaagccaaattgtcttgtaactcagcacattttgatttttttcactgttttcttttctgaataaatgagaataatatttttattgctgtatcttctggccttcacatacagattattttctcttccttcttcccctaaatagactttcagagcactatgaccaggagttattccaaggctagtctaatggaaagtaaacaatctgtatcaagctgggatatacactgcagaaatggaatttaacagtaattcactgaaataataagctacctaagagaaaataagggaatttggacatagaatattgtcattgtgactgttattggtagatttgatcaggtctgtctctgcagttaaaaggaaagaaaaaagaagctggatgtgaccatataactgggaactacaaacagaaagatccatgtattgccttacccttccaattcttttgcgatgatcactgagtgtcagttttatcctcttaagaacaaggatttcacaaaaccactcaagagctattcaagccacaaattaaacaataaagataaatcatgctttattcaatttgatttgagctcccagtaagcaaatatttacatatgcttttaagtatatgttttttaaaatcaactttattaagatataattgacatacaatcaactgcacatatttaaacttacaacctcatatgttttgacatatcgacacacatgatcaccacaatcaggagagtgatcatattcatcatcctcagttcacattatctcttttgtgactccactctatatgcaataactgatccattttctgttactaaagatgagtttgaagattataaagttatctatatatggaattatttggcaaatactcttttgttcagcttctgtcacagagcataattatttcgacatatgatattagtgcacaatctattagaaaataataaattagcatcacaattaaaatgttctgttcagcaaaagtcatggttaggagaaagaaaagactagccacagactaggagaaagtatttataaatgatgtaccttacaaaagatttgtatctatatatatatatatattttgagacactcaaaattcaaatataataaaacaaacaacctgatttttaaaatgggcaaaatacttgaacagaacaaaagcaaaaaaaaaaaaaaaaagaatgaaggctcaaccttatgaattactggggaaacacaaattacaaacccaatgatacatcattgcacatttaatagaatgactaatgttaaagacggaatctaccaaatgttagtaagaatgtggaaaaactggaactctcaaacactcctgataagagtatatgatgtatcgccattttgcaaatcaattttgcagtttattttaaaaagttaaacatttccttaccatgtaatccagctctttcattcctcagtactcacccaggagaaatacaagcgtatgcttatgtaaaaatttgtgcatatacgttcatataagctttataactgaaaaagtttcaaattttccttaactggtgaataaataaataatatggcatatccatacagcggaatactactcagcaataagcataatgaactactgcaaggcaacaacatagagaggtgtttttatagtaaacaatacaatcgtttggtaaaaacacaaagcacatgtaaatccaaatgaggcagaaatattttattaaaattttcatgtttggcatttcaaaaatgttaaccctaatatagtttaaatgtacatatgaatgtaaacatgtttctgtattaaaaaagtcacagaaaccaaagctggaaatgtctaattcgtgcatcattatttgctctgaagtaatgtattaatgtgttacaatccaaactccaaatagacatttaaattcatgttttatatttgtccttctctctcatataatgttctgtttaattgttaaacaaaaacaaaaacaattgtaccttattttgttactctctagtaagagatgtagtaactaggcaatgtcacttagattaccctttttacatctccatgcataaccatttatactgaaaccagcacataaaaagtacctgaaaattaggattatttaatttggtagtgatgttttgcaattggagatggtgttgatatttagttgattacagtaaggataatattagccagagactcaactcagctgaattaaataaaaagagaatacattagcatacattcttggtaaagctatatgtagaggtgatttgacacatgactggagtcaagtgttccagcaagcaatgcctctctgttgcgctttctttgattacagacactccacagtttattacaaaaaaaaagaaaaagaaaaagactgctagcaacctcagcttcacaaccgcagaggaaaaaaattactccaggccaaaaaagccaggagacgtttaatggctctgattggcctggtgtgaccccacacctaaattaatcattttgatcccagtggtatagtaaatagctcattgaagagacctgcttaacctgacatacatgttcatgaaatggacacattccctattgtatcaaaggaaaaacaagatcctgttacaaagagaaaaggtaatggatgatgggcaatgaaaacaatttcccattaacaaaatgattagattctataaagggaaattgacattccctatcatgtatttctatcaggaatagtgaaacagtggtgtgagcaggaggtttactagttccttggaaggtaaaactatggtagatttctgttattggaatattgattggagtatagattaattattaatcctcagaagtttttagattttacttgaaagtttgatttatgtttatctaattgactgtgtgtgtgtttgaggtgagagttgatgatgaaacaaaaacaaaacaagtgtagctatctgagggaaaatgtccatgtaatattggttttacttgttttatttgctttaaaaatttttttttcttccaccgcctatctgtagatcttaatcttaatttaaaccaacatggtgaaaccccgtctctacaaaaatacaaaaattagccaggcatgatggcgggtgcctggagtcccagctactcgggaggctgaggaaggagaattgcttgaacccggcaggaggaggttgcagtgagtggagatcgcgccattgcactccagcctgggggatagagtgagactccgtctcaaaacaaacaaacaaacaaacaaacaaaccataggtatattttctttaaaatatcaaatgaattgcactggtcacagaaacccaggtggaaagaagttttaatttatttgacttatttttttaaatacacatgtaataattagttccccattgtgcggagcagaaattaggaagaagtaaaagtagaaagagcaaagttgccacttctgatgtattggaggaaaataggaaagggggttgcttccgacaagcacaatgaaagatgggtaactaaggtaaatagatctattttaagtttttcatttcatggtcacttttttttttttttttgactgctccttgtggggtagggctaacccataggccagagtgtgctcagagcagcctgcagacgattcttagcaaaactgctggttctgcagtttgttaaaactggtcctctagttgattgtagcaggaaaaaaaggacaatttttatgtgaaaataaaacagagatgttgatatacatttgtgatatgaaaaagtgtattttttaaaagcagactaacttcactaggcagccataaaactcctaaaatgcttactggtcaccgtccattttgagaaaaatggctgcttcacctccacgcataattctgtattcttcaaactgtgtggtccattcccttatgatttggttggtaaacgcatggtgattgtgtgtatgaaaccactccagccacttttctcgggaaagggcagtcatggcagatactttaaatcatcctggtcaattgaactaaaccagaacacaaagagctaatcaggatttaaagattagcacgaatttcactgcaacatgattctaggttgtttttgcctttcgttactatgtaacaaagaaagacagcaaaggctccagtcgataaggatattaatgggagtagctgtagttcctccatatgttagtttcttacagaggtgcactggggttgagagcatcagtagtagaagacttgagccatgacctgtagccttttatgactgtaggattttggtggcctgcatcagcactcaagatttgaaatatcctatgagctgattctttgctgagccgcaaagtgcctctgtattctatttctttgctctagcttatgtcgaatccttcattgcaactacaggacgaccacaggaagctgtgccctaatgtaacaatctagtaggatcaggaactcctgtgaccagtagatttttgttgcatgctgaacagcgattaggtttcctgggatctgaaattgtggaagctgaaatgattttattgtgcctctctctctcagttgttacctgctataatcttgcctgtattctaacctgtattctttgttacataacatttgcttttttccccacaaataaatgtttggaaaatagaattattatggaacttgtttttacttaatgaaatataataaattagttttgtataggcattttgcatgcatctctctgtaaaactgaaacatcacggagtttctttgtgaagcccattaatctggagattcactcttcatataacccttgtgctttctgtaacagaacattaccgataaaattttctatctaatagaacatgggaagcctgatcttagaaaagactaaaagaaaatcaaatacaatggtattattgacatttattaggagttttacacagtttctggccaagctaaacaagacaaatttgtacatttagtcatttcaaaacactatatgaatttctactcctctattttttattcttagacatagacctcacttccttagaagaacataaaatgcaaaatgtatgcgtctggtcttatacatttctatcgctatacgcacccagtcactttctcctaaatggtcatcttgggttaccaaatgtggcatgttctcatttataagtgagagctaaacattgggtactcatggacttaaagatggcaataatagacactgggaactactagaagtgggagggagagagggaggagagcaagggttgaaaaaccaactattaggtactatgctcactacctgagtgacaagatcaattatatcccaagtctcaccatcaggcaatcaacccaggtaacaaacctgcacatgtacttcctgaatgttaaataaatgttgaaggaaaaactcagacattaaagagatttgtaataaaaaatatatgtaactatattggcttaaatcttcctacttacaagagtttcacaaaatttctttctcaagtttaaaacctattttctttagaaagtaacccatttcatggttgctcaatttttgaagttagtaggtcaaaatcggcagaagaaataggtaggaataggtggaagcatgaggtccctgccaatggatctatgctaatttctcaagtagaatgactacttacatcaggaatgggcacagtgttggagtccaaaaagatggactttgaattctagaaagatttaattttgaatacttcatcacagtcacacttgctaaaacattaattctgtctaatacaggtctgcccacagcaaggctatagttcaatttcttttttattgtaaacagtgagtttcctgaatgagttttatttattcatttatttattcccaacatagtagtaatttttttcatatttcttgttttatatgagagatattttaagtttgaaaattatacacaaaattttttaattgatcaaacacaaaaaaaagaaagacataggtacatgcacataaatatttcaataatataattattcagcttgattctggatattagccctttgtcagatgagtagatcgcaaaaattttctcccattctgtaggttgcctgttcactctgatggtagtttcttttgctgtgcagaaactctttagtttaattagatcccatttgtcaattttggccattgcttttggtgttttagacatgaagtccttgcccgtgcctatgtcctcaatggcattgcctaggttttcttctagggtttttatggcttaggtctaacatttaagtgtttaatccatcttgaattaatttttatataaggtgtaaggaagggatccagtttcagctttctacacatagctagccagttttcccagcaccatttattaaatagggaatcctttccccatttcttgtttttgtcaggtttgtcaatgatcagatggttgtagttgtgtagtattatatctgagggctctgttctattccattggtctatatcactgttttggtaccagtgccgtgctgttttggttactggagccttgtagtatagtctgaagtcaggtagtgtgatgcctccagctttgttcttttggcttaggattgtcctggcaatgcaggctcttttttggttccatatgaactttaaagtagttttttccaattctgtgaagaaagtcattggtagcttgatggggatggcattgaatctataaattaccttgggcagtatggccattttcatgatattgattcttcctatccatgagcatggaatgttcttccatttgtttgtgtcttcttttatttcattgaacagtggtttgtagttctccttgaagaggtccttcacatcccttgtaagttgggatgttattccctttgaagcaattgtgactggaagttcactcatgatttggctctctgtttgtctgttattggtgtataagaatgcctgtgatttttgaacattggttttgtatcctgacactttgctgacgttgcttatcagactaaggagattttgggctgagacgatggggttttctagatatacaatcatgtcgtctgcaaacagggaaaatttgacttcctcttttccaaatggaatacattttatttatttctcttgcctgattgccctggccagaacttccaacactatgttgaatacgagtggtgagagagggcatccctgtcttgtgccagttttcaaagggaatgcttccagctttgcccattcagtttgatattggctgtgggtttgtcataaatagctcttattattttgagatatgtcccatcaatatgtctcatcaatttattgagagtttttaacatgaagggctgttgaactttgtcaaaggccttttctgcatctattgagataatcatgtggtttttgtctttggttctgtttataggctggattatgtttattgatttgcatatgttgaaccagccttgcatcccagggatgaatcccacttgatcatggtggataagctttttgatgtgctgctggattctgtttgccagtattttattgaggatttttgcatcgatgttcatcagggatattggtctaaaattctctttttttgttgtgtttctgccaggctttggtatcaggatgatgctggcctcataaaatgagttagggaggattccctcttttcctattgattggaatagtttcagaaggaatggtaccagcttctccttgtacctctggtggaattgggctgtgaatccgtctggtcctggacttttttaagttggtaagctattcattattgcctcaatttcagagcctgttattggtctattcagagacttaacttcttcctggtttagtcttgggagggtgtatgtgtcgaagaatttatccatttcttctagattttctagtttatttgcgtagaggtgtttatagtattctctgatggtagtttatatttctgtgggatcggtggtgatatccccttgatcattttttattgcgtctatttgattcttctctcttttcttctttattagtcttgctagcagtctatcaattttgttgaccttttcaaaaaaccagttcctggattcattgattttttgaagggttttttgtgtctctatctccttcagttctgctctgatcttagttatttcttgccttctgctagcttttgaatgtgtttgctcttggttctctagttcttttaattgtgatgttagggtgtcaattttagatctttcctgcttctcctgtgggcatttagtgctataaatttccctctacacactgctttgaatgtgtcccagggattctggtatgttgtgtctttgttctcgttggtttcaaagaacgtctttatttctgccttcatttcgttatgtacccagtagtcattcaggagcaggttgttcagtttccatgtagttgagtggttttgagtgagtttcttaatcctgagttctagtttgattgcagtatggtctgagagacagtttgttataatttctgttcttgtacatttgctgaggagtgctttacttccaagtatgtggtcagttttggaataagtgagatacgaaagagaggattggcaaattggctattaccatactttcactaaagcatgagaacatttcccataagaaattgacatatttacttaaaattattctaaacattccatatccagtattttaggcattattgaaaatggttgtcactggaaatataaaaggccttttcatgattctgtgttgtcttattgtctgaatatgtgactctccacattgacaccaaattgctctcctgtcaacatgtaaaaggatggatcattttatcttctgagcgatgaagtttcaaatccacaaagcacaggctgtcagtcctttgaggtgattatgatgcctcaaacctgacagcttgccctgacagctttcacatattcctgaaatcaaattgttcctgcttctattagaagaaggcaggtgtgtgaaaactagaggaagaagaaggtaaatagaaaataaaatgatcttcatgtgcagagtaattataaaaagctgtttccagggaaaagtgtagatattgattttacctctcttcctgatgttcacggatgagaccacaaagaacccatatgggttcaaggtttgccaggaaagaaatatcaagataagcagatggcagtgccattgccatatggctgcttaggaatggacctatgtgatggcattttgccataagacaaagctagaaatattttcctgatactattttaaacagcacaaaaaaagaatatgtgtttgttgacattaaaaatcattagaaaattatgacagaaatactttattatattcaactccacaaactggctctcagacttaaaaacaatttaaagtggatgagtattttttatagtttgaatacagaattatatggataataagaacttctttcactgtgattagtcagaatatttttgaaggcatatatataactacaacttagaaccaatgttggaacatttacaatacaaaataataagataaatatcactgtgaaagttatcaattctcatattatgctggtgtaaatgaaaattccaagtgaagaaaggggtatagttagatttagaagctgaagagaaaggcccatggcccaggtataagttatgacaacgtcaggaatcagtgaatccctctaaactacaatttcttttactgtaaaatatggtattgttgagaaaagccatgctatgaagaacaaagaggacatttgaagttcacatagaactcaattcaaattcctctcctcctgttaccagctttaccttttttttttttgaaaactaataaaactttaaactctatgtccctatctgaaggaggaggataataatatctaaatcatagggctgtcgtgagaagagagataattccagatgactctgggtaattaaagaaatgagcaaaagggaattggaggacagcaagtttatctcaggcatacttattagaagtgattgaaaagcagagagtgggtcaactaccccaaccctggaagcatctcatctgactgaaaatgcttagtttgttctaggtatatcgtcttttttttgagacggagtctcgctctgtcgcccagcctggagtgcagtggcgcagtctcggctcactgcaagctctgcctcccgggttcacgccattctcctgcctcagcctttggagtagatgggcctacaggcgcccgccaccacgcccggctaattttttgtatttttgggagagacggggtttcaccgtgttagccaggatggtctcgatctcctgacctcgtgatccacccaccttggcctcccaaagtgctgggattacaggcgtgagccactttgcccggccggtgtatcatcttttaagtgactttcctgtgtaggggtcaagtgaaaactttcccttcactctctgaaaattcactgaaaaatcaactgacaaaagacagattaatagaagaaatggtaaatcaatttattaatgtatatgggggagaaccatagagtaaaaacttcaatggggtacagaaagttatatagcttttttgcagatgggtggggggcgatgggaaatacaggcaatcctgtggcgaggcaatcaattattactggggacagagtttaacttgtaaatggttctctttgaaacggaataagcctagagtctgttcatgtgtggttgcattctctcattcttttattataattttttgtaataatgtggtaatagggagggaaggaaaaacacttgttatccttggaggatcctgcaggtctttccatagatagcagaaatttctcctccagcatcttgatccttaagggtctttaattcaaaatacccattataccatgtagcagtattttggagggaaagagtttggtaacctttatacggcacagagaaatatcactagctacaagtatatactttggagacatttatctcatattgacaaacagctttccagctgtggcttccctggagaatttggtgcagcctatcttttgtggatcctcacaagtttcctaatgttccatttaaaagagcaggtcaggtcgcatttgccctagagtgcaaggcatggccagttcatgcaagcattcacagccacaagctgatcaaacaaagcttttgaggtcagaagcacagatttctacccatccattctcctccaatatgacttccctaatccagtttcccagttatatcattatttttattgtttctcctcccttttaatgattctgagaatttaagtgaaaaactttctttacatatccgaaaactattcaacaataataatatatttgatcattgtgttctttataaaatccctttcccatatgtttctcctttaatcttttaatcagtcctgtgaggttggtggtattataccatctccccctaaacatattaacccagacacatgatacagataaatattttaagcagttgttagacatgatcagtgacaaataatcagtaggcaataaagctgggaagaataacaagccatatgatcaaaatatacatgtcttttcataatactgatagggctggtattaacttgcttacttttatagatgtttttattaaagaagtaggtagagctgggcgtggtggctcacacccgaaatccagcactttgggaggccaaggcgggtggatcacttgaggtcaggagttccagaccagcctggtcaacatggtgaaacccagtttccactaaaaatacacaaattagccaggtgaggtggctcatgcctgtaatcccaactactcgggaagctgaggcaggagaatagtttaaacccgggaggcagaggttgcagtgagcttagattgtgccactccactccagcctgggcaacagagtaagactcccatctcaataaaataaaaaaaaaagtaggtatagaattttttttactttattcattcagattttcttcaaagattactgatacgcaactacacaaaccatattgaagtttaatctctcctttaatattttttccaagtacctgataatacagagaccatattttatttaataagcattgtatgtggaaataaacaaacttcaaacagaaaagacagctttgaacggtgttaacaaaggaagaccatgagatctacagaggcaagaaagaaagctttattttctgaaaagaaacaatctgtgggttagggagccacagccttctgagtataacaaaaatgtgctccaaggaaggattggagagttacagatgatacactgaaaacacagatgatacacagaagaggggaggcgtggtcaggggaataaggaagagagtcttgattggatgctcccaaagcaccagtcgctcttaattagctggttccaagtattggtcagttgatgccaggtggtctcttggtggtcagtgggaaatttccagctgcagttgtttttgacattgttttcaggaactgtccttcaacttggttgcagagtgactgcaagctccgactcccaggttcacgccattctcctgcctcagcctcctgagtagctggaattacaggcacccgccaccacgcccggctgattttttctatttaccacgcccggcaaattttttgtatttttagtagagacagagtttcactttgttagccaggatggtctcgatcgcttgacttcgtgatccgcccgcctcagcctcccaaaatgctgggattacaggcgcaagccgctgcgcgtggcttccggttctactttttaaccttttgagccacagggagtccaccttgtttgtcaactggaggcataatttgacaggggtctgaaaaccgagagcaactcaaatgaatgaacagattgaatgaatgaatgagtgaatgagatgaaaactggaagcaattaacccattaacattttttaaaattggggcctataatgtatgagaaagtatgaaaggtgctaaagaatgcatgagattataatatactttcccagatctcaagaataaaattaaaaaagaaaaaacatagccagggcaggaagattccctgagccaagggttttgaggctgcagtgaacactgatcacaccactgcactccagcctggggaacagggcgagactccagctgtaaaacaaaacaaaaaagaagaagaagaataaaataagagcagcaacgctgcagcagagatttgtgatttgttgcactaaattaaaaactgatagcacgttggtgagttgaaaagtgccctaaagtaggaatctgaagaccagagtcagccacacatcagatgaatgacctaggactcaacaactcccaggcttttattcattagtgaaacggcactaatagtaactgccctgcctcctacacgggcctttatatgcatgcatatcaaataaaatattctacaccaatttttttcaaaatatcgatgtagaaattttgaaatttatttagacatactgattgtttttagccatctcttcagtgactcatggggaatatgagaaactgcaactagttaattggggctatcattttcaaagcagggaaatgaacttctttggaaccaaaaacacagtttacaggagtgttgccttaggataaatatattgatgtaggcagctaggagaatcggctagaagtttgatcccagatcagactagcaagaaagatagcagtattttgtagtttgagaaatgtatatgcattttaagtatacaaagaactgaaatgcatacaagtaaaatctttgttaggaggacactgcctgctatttggaaattatatatttttattaagttgttctataaaagtaacacattacatttgggattaactgaaggttactgttagttaaaaatgatactacagtggttgctgtaatagggaaatccttaaatcttagtgagttaccatagtaaaagtctctttattgctcaggtaaaatccaatccagagtgggttggtgtgtcccgagtttgttccttccggtgggttcatggtctggctgacttcaggaatgaagctgcggaccttcgtggtgaatattacagctcttaaaggtggtgcagactgaaagagtaagcagcagcatgattttttgcagaggaacagaagaacaaagcttccacaacgtggaaggtgaccccagcgggttgcagctgctgacaggggtggccagcttttattcccttatttgttcctgcccatgtcctgctgattggtccattttacagagtgctgattggtccattttacagagcgctgattgctgcattttacaaacttccagctagctacagagtgctgattgctgcatttttacagggcactgattggtacattttacaaacctctagctagctatagaaaaggtctccaagtccccactcgatgacccaggatgtccatctggcttcacctctcattaggacaggaggttagttgggagttttggaggaggcagcttctatcaaatgtccattcagaacccgagctgacagagccaccatcttcagcacttggtttccaaggtgattctggatgtcagcacccatcaagtgaccacgagcaaaataatggatgaaagactgaggaagattttattttattttatttaaagattaagttacattttattctttctgtgtgtgtaggagatgtttgaaataaaactggttaacaccatttacaccgataatccattgcctaaaatttagtgacatagacacatgaaaaagcggatgaaaaatagtgttgtgtgcccaaaaagtaaggaaatataaacaacccaccattctttgtcacagtcttgagaggtgaagccggctgggctttaaggaaatataaacaaaccaccattttccgtcacactctgtccttctgttcctcaagcaactttcgtattttgctctagcacagaccgcacttatgggaggtagtcccaaatcccattcagtcacagctggctcttatctacatgggactctgagctctggagatctgtaaattaaaaatacagtttatcttaaacctgccctgagaagcaagtatacaatggagaaggggcaatgtaacaacaacaaaaatcctagctcataaaagggatgagagggaacacacctccatcattggtccgtaggaaatcttgctgggcaggcagatggcgggcagggggcagcccccgccgcaatcgaggataatggaaacgccttggctagaccacatatctgctatctgtatggaacttctttgatggccgacctcctttgccctggctccaccagctaaaggattttacgtatgtatcaatgttaacagagacatgacagaagggggtactgaagaggatgcttctcctgtaggctgtaactttcgcagccaatttcatattagcaaaattttaggaacaaaatagtcaaataataaaagactttattttttggtttgagattacaggatttttgacataaaattcaaaatgacgattcctcaaaaatggaatcatcttcaaatatttgttttcagtaggttccaggtgacttctagagttctgccttccttactcagctgcttccttgctccgcattttcttgctcaatttaatagaggtgaccttgagaccgctggccttcatctaattattattgcagaactgggccaaaaagaattctgatgttcaaaatattttaacattgtatttatattgtttggaatctagaagctaatctacagtggtctcaaatatatgcattttctctattccctttcatttttgcttgcaaataaggcaattttcacatgatgccttctcattcttataatatattgctaaatgcagctaatagctcccaacatacattactaacttctgttttccaatctcttcccccagagctggaagcttagtggacatgtggtctgcctgatgagttatcacagatgacattttgaacatttgttttcccactgcttaacggttatctccattttttttttcagtctcttttattagtatcttggtagctcattgcctcaccaacaatgacataatttaagattattattattattattatactttaagttttagggtacatgtgcacaacgtgcaggtttgttacatatgtatacatgtgccatgttggtgtgctgcacccattaattcgtcatttagcattaggtatatctcctaatgctatccctcccctcttcccccgccccacaacagtccccggtgtgtgatgttcctcttcctgtgtccatgtgttctcattgttcagttcccacctatgagtgagaacatgcggtgtttggttttttgtccttgtgatagtttgctgagaatgatagtttccagcttcatccatgtccctacaaaggacatgaactcatcattttttatgtttgcatagtattccatggtgtatatgtgccacatcttcttaatccagtctatcattgttggacatttgggttggtcctaagtctttgctagtgtgaatagtgctgcaataaacatatgtgtgcatgtgtaaatcatgctgctataatttaagattttttaaagttagtatcacatttctgataacaactctcgtattaattaagttaatgctagttgctgtaacaagaaaagtttgtatcttgctcaggtaaaacttgactggggaggaaagaagactagctagacacattctagaataagctgttggaataaaaaaacacatgaatttcaaagttatcctgggatttttatatctagctagtggatgaagaaataaagagaactacagagaaaatatttggttggctatgactagaagtattatgacttccagtcacataactgattgaaataaatcacatggcctcatgtagcagttttggccaagaaatatagtctaagttcaagagaaaagaaaaaatgaattttctgaaaaactacacagtctaccaataattgaagtattgcattattaacaaattctgttagcttcagtatattcatggacttgcccacttgtttgtttaacattttgagtaatcattactttctaggtaacttgactagttgaatttacagattgcagaatgtataatgtaagataaataaagctctgaaattattatgtgaaattaaccagtgagcccacttatttgctgttacaggcagcagagtaagaggcaatccggggctaaacttgggctacattttgaatgagagaaagaaccgggcaacagaagactacaggcaaaggaaatgtaatatgcaaagactcaaagtactatatatgaagaaaaaacaaaaaactgtaattcaacagcctggaacataaggtgcgtgaggaaatgtattgaatgatgatgccagacaggaactaggatcagaaaacaaaaagagctgaaatagtgtgacaatttaaatacatactatattgatttatttaaatatatttatacccacataatgtaaataaatattattacatatgtatgtaaatatatttataaatgcattcactgatttgcttttgagtctgtttcaatcaagatgcctctttcagaaaaaattgtctacttggctttattagagtcaagctctaaaacaaagaccaccaggcttatgaaaaactaagggtgtatcttatgggtgtatatttatctctagaaattctcagttctaagggagaagattttgtgacattttaagactatctcagagacttatggttttactggcatttataatgactcacccttctgtgtgttgaataattaggcagtccctgctgacttaggtttcttccattaccattaatatccagcaacctgaaattttcaacaaatgcaatctctggtgatacagaaagagtgagtttaaaaatgtgacatttgcccataatgtagaagaatttttctttttcagagacttcataatatcctcttttaactactcatatgctctgccctgcagcacatcgctttgtgaaaacatcaagtagaatatgaaactcagagatttgggtgacaaatactactcagggctccaaatataagtttggcataagaatgaaataaaagcaaaacattatttatttacaaacaaatataggacaattagtatattgttatcattcaaagtaaactcaagttttgataggaaaatttaaaaatcctctaagactaaaggtaatgtgggatggcaatgctttcctttgtacagattctttcaattcgtgtgttgtacctgttttcttttttttttttccccaaaatcaaagacataatcttcagcccataactgatttcctcaacaggtgcaatcacagcattttctacctatgatccagaaacagttgaatatctgaacatcatgggtgggagacatactgaaatttatgtaggcttctattcaactatgtggtgctaactcatctctctgttcaaatattgtctcacttacttcctccatgttttttgatatgccgcctatgttttttgttgattatgtggaacattttctatcttctcagctcttgctctcaaacttgtgttcacaaactggtcaaattctcaggaacaatatgagaacctctggttaaccagagccagagtgatgaaatgacagctggtttatgatcaatgcaagttttcatcttcatatcattcatatcctatcactcaggcagatatgtatatacacttatacatatcaccaggcagaagaaaactgagagataattgtaaagaatctccagaggctctttgcaatcggtttaccatcaggtaaatctccctgacaatgtaaaatactctaaagattttgtttcaaccactttaaatgctctggatcaaatggattcctttatattttcccaagccatcaccaaattgttcctttcaaaagtgttttttccctggaaaggcaggaaagagaaaaagatcaatattttcatcttcacccatgtatatgggcatgacttaaaaaaaaaatcaaactatttaagattctgagtcattattttcatatttattgtaatagtattgtggttatgtttttgaaaatatttcattagtaatagatactgacatcattaaggataaaatgatatgatatctggtattatcctcaaaataaccctaggaaaggagaaaattgggtagagacagggatgaagcaaagttggccatttgcttatcattgttaaagcctgttcatgtggttgatgtgtgcatgggaatccattgttttaacatcttttgttatatgttttaatatttccataataaaaattaaaaataagatttactcagagtcaagatacaacactacctaaatattctaaatattagctcttctcttactcttctgaggactacatactaccatgtgctaaataaaataacagtcaattcacactcccatctgtgtcagtgtcatcaaaaactgggtgtttccttgctggttacaataataacagtaacaatgaaagtagaaccaagcaacgatgttgtcttagttcttattggacaactgtccagtatctccagtaggaatatcaaggtctgaaacaacctcgcactagtaatttctgctttattcatacttggccacattgtccactgagtggaatcaacaggaattgctacacggcagaactcaatgacctatcaagttcctagcctttcttatgtcattcatggcccaaagcccagcttttacactagtgtagctgtccttaaattgcaggcaagcaagagaggtatcaccaggaaacttgttatgagtataaattctcaggccctgcttcagacatactgaacaagaaactctgggagtaaggcccggtgtattagattgctattgctatgtaacaaattgacaaaaatgtagcaaattaaaacaacattcatttatcagctcatagatgataggccaaaatccatcacagcatgattaggttttctgctcaggttataactaggctagaataaaggtgtaggctcagctgagttcttgtcaggaagctcaagagaaaaacctccttcccagctcactgtggatattggatacatccatttcccgccaaatagggctgaagtcccatgtcttgctggctgtcagccaagggctggcctcagctccaagaggctgcccttgttctttgctgtgtggccccttcctttgttaagtcagaatggtgccccatgtctttctaatgtttctaatttctcacttcctccattactgagtgactaactcagagttaaagggctcatggattaaatcaggcacgatctccctctcataaagtcaactgacttgggaccttaattacctctttgataatgtctttacagcagcaactaaatttgtgtttgattgaatatgtgtgagaaggtgtacatacaactggggccagaaatcttgagggccgtcttagaattctgcctactacaggttaacagtctgggttttgacgagttctcccggtaattctgaagcatgctaaatgttcagaaccaaaactcttgcacttagttctccatttaatatgagccactcttcttggtttcctagggctttctcggtttcaacatggaaagtccggtgtccaggaaatcccactagtacagggcaaacccatatgggttactgactctaggtctctgctttccgtcccttgtctgtcctaacagaagccctcatctcaccattattatcatttattttacaaaacgataaagtactttttatcagtggctgaaagatgcacctgtacatattttctaccctggagatatttcatataatttgttatgaaattctcttaagttagcatatgaatgcacataatgtgagatagagctgaaactgaaacatactatccttgaaacacaaatttaacttctattgtttcttaattttagagccttcctcaaaatataactaacatgttatttctaaataaatgagtaagtgaatgagtgaagtatatgtgcaactgcaattgcttaattgctgaagaaatcattataacctactaaatgttagtctcttctgtctactctaaaatattgcagaaattatgatacttgctttgtcagagactcaaactgggaaaagcactaccatttgaaattttgagagaaaagaaaactgtcatatccagactaccaattaatatttttacttagaggtgaccacgtaattttgttcacttgttattgatcaaaggacattgcatagcagtgcctaacttcaagtggcaagagagatatcattccagatgcctagggaatatcacttccattgtgtgtgtccgtgtatttgtgtgtctgtctgtgtgagagagaaagagagagagagaggaaaagagtagtaataaagtgtatatgtctgtgtgtgagagagaggacatctctcttttctatgtcagaaaaactaaaattctcatgacagcctattatattagaatgtcagaagaattataaaagtaagtttgtgattctagtaagtaactgggggatgggtcataatcaataacttaaactcagaaatttagacagtttggcaatggctgtcaaattttgtagaaacaagccatcaaaaggaatattgttatatcattttttgttaagtagtaactaaaattgtagtactaatatgattagttaaattttaattaaaataccaaaaactgttttaatctagatgaaatttggaagtctatttatgtttataatttggaggcaaagtctacagatatggaacctattggaaacaattgagcctgttttcatctcccttacataaaccaagttcatgattccattggctgagaaatcacaagctctgtcagatactcaggtcaaatcttatgccattcttggtttttcccaactgcaggtcagaatctactgcaagactctgaaaatggttaaacaaaggaagaagtagaatttgaaatcaacagaagtgctcagggtagattagagctatcattggtctataatcctttcattataaaaaaaaaattggagactagtgtggattatattgaagagaatggttttcatggtaaaagggagagatggagcctagatacttctattaaataggcataaagcctggaaaaatcaatttaatcaaaccctgcaaatattggaggaggtatctggtttgatttagggaagagtttaaagtcaagtcactcttttagtgagaataaaatttcctacttctatgtaattcttggaaaacttttaagtttattattatcatattaatatctacatcacctataggtaatacacagtgttattttcaatagggccaattgaaacagaagcactttgcagaatgagaaataggtgggccttgcctttattatagatgatgatgatttgctttataagtacacactaaaactgagatggaaggaaaacactaattcctaaattttaagcatgctctaaaattttacatccgcaggagagtgagagaataaacatgttggggtaaatgtgtatatgcataactgtatgtatcttcatttatacctacctatctatccatctatttatctgtctgtctctctgtctattatctgtctatcatctatctatctatctgtctgtctgtctgtctgtctgtctgtctatccaaatctttccaaatcgtagggtttttgttgatgttgtttgttggtttccttaaggacaagtcttggggtgataggcattttaaacattttggtatgttgactgaactgcacatcaagcctgtggcttacaagaaaactcgacctattttcatgtctgttggatatatgtcaacaagtatcatagaaccctcatccactttgaaaaatagcgtagttgattttggaattaggaacatccatggcatcaagaaaggtacctgaattttcagccatcccccgtgttacagaactatctttgaaatctgttgttgtttgatgggatttgtgaaacaaagagaagagaaattttaaaagatccatttggaagaagtaagaatggagtttgaaaggattttctgtgaggaaggtaaagataaaaaatgaagctttcccaagagcaacgtctacaggaggaaggtatacatcaatcactgccaacagcctccctggaggccgttgaggaacagatcaaatgcaaacaagccagacggggaatgtggacaagcagttgccatgtcattcactcttctttcaaagcaaataaaggggaggccaggtaagctatgtgagtccacttatgtgggattttaatgactcggaacttacaagtaggttcagattcattcattcctctttaccttgacctggtcctggactttgcctggattgtcaggtagcagcattttctttcccaatctgtgcataataacggaagaattatacatgctgtgggtgctgtattaaaaggaatttaatgtgaacaacaaaaggttaaggccattttcttcccaaagtcattttgttcctttctctgcccttaaaaaatactgcaacagaaattcatcacattcgagttgatacaacactgtcagaattagacactacatactaaaaccttgttataattctctcagcaggttctagaacttcataatttcttttaaatgaagagaatagatttccaaaatgatgaccactcctgaattatattaaatgttaaatcatttaaatatgattttcaaatggtttgaaagtagctatgtatataatgtcacacctacgcttacacaaactcttcattatttataattagttttatggtaaagttttattctcatgattattcataaagtactctcaatagaagatcctgagggtaaagactctttaaagtgaaaatattctataaacgaacacctgaattcttattttataatgtattaacaaaacacatttgtattattttgtagttcagacgtctttttccttttttgagtatatctattgcattttacagatataacctgtttaacttctatatagaaatcttattttgagaaagacactaataatcataccagtaagatactggtttactattaaaagttatattactaaattttaataatgcttatgtttcttccagctgtgatgcaatataagcatcatttcttgaatgcctttagatacagtcagtgtataaatcatgcatgcctagtgaaatgcattataggtatcgagcgtcttgtcttctcaagtccattattgtgcttagtgcacatgattatcactaacagagaaaaaacatgaaggtctaaacatatttatattttatccattttccctttttaatagatgaaaattacttgttgtgaaatactggcctttagctttccctaacaatctcagaacctaggatgtttatacagggagagaggtgaacaagtgaggtgaaggggtgaaaatagcatgacatgttcagcaatttatttcttgagaagaggggtggaaagccaagtaagatggctatatattgttttaatttattttgctaaatagctatcagtgcccattgtggtcattgtatgattgttattgaaatttacagaaagagataagaaattggtaggacaacctgaattcctgttcacattttattcatatgatgattattccaacataaatctagtctcctgtcattatcctcgctctttcatattttttttaattttttaaaaatcatttcctcctttagttggtcattgggctcatttacatacacacctttctaaaagctggaaatgacatattattttgttataattctataattttaattaataataaattaatacattttaattagtaaatgtgtacaaaaattaataaatatatatatatatcttgtataaagcttaatgttggtttcatgttgtcttatcttttaaattatttaactgatacttagaagttgcctaattataaattgaatgcaggaggaataaaagaacaagctataggttttagggggtctgtatcagacagggtttgccagagaaacagaatccataggatatgtgtgtgtgtgtgtgtgtgtgtgtgtgcatgcacacacacacacacacacatatggagagagatttattttaagaaattggctcatgcaattgtggaggcttgatgagctacacagtctgatggcagaagctgttagactcaggaaagagttgtacttccagtccaaaggcagcctgctgtggaaccaggaagatccagtggtgcagatgaagtctgaaggtagtccactgagaattctctcttgctagaggtgtggggtggtcctgagggagggacaggaccgcttttcattctgttcagcctttcaattgattggatgagtcccacacacattgtggatcgcaatctgctttgctgaaaatctacctgtttaaatgtcaatcccaaccaaaaacgccctcacggaaacatctaaataatgctttaccaaatacctgggcactgtggtttagacaagttgacacattaataatcacagggtcaaaaattccattctgatattgcaagcgtaaccaataatcccagcactttgggaggctgaggcgggtggatcacctgaggtcaggagtttaagaacagcctggccaacatgatgaaacccctctctactaaaaatacaaaaattagcctggcatggtggtgggcccctgtaatcccagctacttgggaggccgaagcaggagaatcgcttgaacccaggaggcagagattgcaatgagctaacatcgcactactgcactccagcctgggtgacagagtgagagtccatctcaaaaaaaaaaaaaaaaagatattatgatagtataatctctgaattataaagattatctgagaaaagagaaaataggagaattttgagtgagaaagtgtactggaaaaattccatctcactgtttaatgaaaaaatctaagtaggatatggctcatctagatacaaaaggtggccccgataatccctttctttatgatttctgtgtttcagtgcatgcaaaaaagaattattcctgttgaactaacaaactagtaagaaagtctgttttatcatcctataattcaaggagtcacacatcagagaaatgcagcacgatgccaccagctcagagaacataaaacatgtacccaaatacattgggggaatcagagtctgagcccagcaaatttgaatgaattgcaatatgggccactatgagacattttgaagaaactcagtgtctgataccagcccagaaccatcttattcagatgtgtgatgcatctctctttgacttaattcctgccactggcatgtatgcaattccataaatagattcttacaggggatcccttggttgggccatgcttctttccaggacaataatgacaagaacagtaagggatacctaagatgaaatttctgaaatgacttattattagtttatatatcctgagcagatcatttaatcaaaagtctcaaaattctctgccatgagtcagattaaattctctgccaggagtcagattcaaagtcaaaaattaaattgatttccagaaatatagtttcaagatggcatatctgaatcacattgactctagaatgcttggaatattgtaatcattacactaagaaaaatatcccagttttagcttcagtcatagttttttattttttgtttggtaagtaaaatattagcatcatttaaaaaacagaaattaagtacagccagatcacactgagatttaatctgaaagacaaggaccaagtttatgttatctccatcagagctatagtttttcaccagagacttttgttaagtttttgatttattttcctgtctcaataacaaaaaggcattctatctggcttctgttggataattgactaaatcttcagtgtgctcatccaaatattttgccccaacttgggtcagttgtctaccatgttcttaacagttgtgattatgtaaataaaaccattaggcacaaatatgacccccagtcccatatcttctgacgggctgtgggtcccatatcttctgaggggctgtggatgaaggcaaattatcttggaaagtgtcagaaagtagtcaataagtattatctcagaacaaaatgcttaaaaatactcattttacttttctaaaaaccatacaaacaattttcaatagttttaaaatttcattcaaaacatatattcacgagaaattaatatgttttttatttcaaaattatcttaatggtaaatttgtctttttttcttttttttttttttttttttttgagatgaagtcttgctctgtcacccaggctggagtgtagtggcgtgttcttggctcaccgcaacctctgactcctgggttcaagtgattctcctgcctcagcctcccgagtagagtagctgagattacaggcacacaccaccatgctcagctaatttttgtatttttagtagagacagggtttcaccatgttggccaggatggtctcaatttcctgacctcaggacccacctgcctcagcctccggaagtgctgggattacagaagtgagccgctgcgtccagcctaatttgtcttctttttaaacagatctcctccagaaaaaaaaaaaatcacccacaattgcttaacttttataaagtccatggttaagaattcatatttaatgaatgcacataatttgttttcactacaaaatttaaaaacacagttactggtttacagaatttgaggattagtctttttcctaactcactaaaaaaccacccacaaatctttactttcacacatattggaagtttttcactaagtaattgcataccagaatttggaaattggtattcatatcacatggggacagtgttgaaccttaaatcacattctttctttaggtgacatcttataacattgaatgatggcataatttttgtatcagagtttcttcagtcttaggactcttacttttttttcctcttggtttaaatgacacaattacagcaaggacaaatttagtgatttgctcttttggtaacatcttctctaaataagaacatctgttttacagtcacttcctgtttatagggtaagctattgtagttaaattttaaaatgtcaaactcaatcaaaaatactgatctgtttcagtgtgcaagggaaatggctaatgtgtataacaactcaatataatctagtggcaagaatactctgctgggaatagggagggctgctttctattcccaattctctcatgaattattggtcttgtctacaaaaggataaaaagttattccaaggacaaacaggctaatgaacctaaggaagaacctagtatataaatgggagattctgattgctccaacaaagtatttatgttctcaattaaggttacactattctcttattttgaacataactggatttcctactatgtctttaagtatttgtgacatatatggcattaacctaaacataaacagggattgactaagcagaatagagcaaaggaagtggtgtcttggtggattttggctgatgggcgcaggggtcaactggaaggtgtcttgagtaccacgtgggctaaggaatgtgttggaggcaaacaaaatgcaagagaatactgaaaaaacattccaatacctagaaatttgctctgacgctgcagaatgcttcttaaaatttttagtagcaggaacctaaaacacgaagtctttgcacttttctctttatgttcgctcataaagggtgattctagaacttctatgatagttgtggtagtgcagtgtagtcatctgtgacttatctatttgatagcataattccagatgaccagaaatgccagttggcccgaactgaacaaattttactgccagatgtgcagtcctaatcacaatgtgtgcattctattcagcaagcagcaatgtttcttgcttgagcaacagctgtgaactgccaaagcatatcaattttgagtgaaatttgactcaaataattacttgaaagtatgactaaaaccactgtatttctaagggttttaagtaggaaaaatttagagtagtaaagtgaaaaaaaagaaataaaaacaaagcagcaacaaactagcaaacaaaaatagaaacgatggaaagatttctcaaatgcatttagaaatggcgaatgaatacataatcttttcctgtccatatcttcccctcattcctatccagttgttattgaggataagcaagagatttaaagttgacattcaagttgacaaaaaaagacattaaacctaaaattatgggaagcacagctgagagttaggaaactatgttttctggtccagtccctgatatgtcaataacttcaaactgcagaaagacatcatccattcccttttcctcttcattctgtatttaactctttagccgtttgccccagctaaagatcactttaccctattgtctgcataatggcaacaccagcaaaattaccttaaatttgctatgatgtcagccgtgtacacataccccccccaacttataatcagtgcacaggaaatttcagtgattcaaagatcactgaaattagtgcttttttgtttgtttagttaattgcatatatgtataaggtgaggtctttcattgtctagtgtgatgagacacttctgtgctgtaggtattaagaatgattggtttactttgaagggcaagcacaggatgagggaggaattgctagtttaatcaaagatcctttgttattagggattgctgcaattaagactacttagaataatgatacagggttagtagtcatcttcagagagagagtaggagagggaaaatgggagaagaatggatttattcaaatctagtatttccaattattaagtaaaaaaataacaaaaacaaaaacaaaaaacctgcttaattgtggaagaaaatctgcgacagagaaaggaaacgtgattctgggcttgataaaacctctgtgtcctgctgtcgcttggagaagtgatattaatgagcaggccgaggtgctgatagaggcaagggttcctttggaaaggaagaagtatactgcccggtcaccataactgggctttgatgcaacagttctggtgagagccctcctgcagcccccatcattgtcatttctcttcgcctacttccttcccaagaaataacgacctctaacatgcccaagacaagagacaataacccatattatagaacttccctcacattcagaaaataatgggttacaacgacatgccaagatgcagaagattcccaaccataagccccattggctttgcagattctgttgcactaaatagatagagggtaccatgcttgcttctgttaccagtagagtgagtagggacttgagggtcagtattcaggggatcgggtagaatggtgtttctcaaactttataatgcattcaaactatctggagatcttgataaaatgtagattatgacacagtaaatcagggtgaagcctgagagtctgcatttatttaaaagctcccaagtaataaagatgctgcttgtcctttgagtaggagaggctacagcacaatatttacatcctagttggtggagatgttgagagtggtactctggttacattatcattatatgggaatctagttattctttattatgtgatttaaaactacgatcagtgggcttattgcattttagatctaattctttaaacagttaaaaagacagaacaacagaaatctgcattagattgcatatttcacccctgttaaactgaatacctcaccccacattttatgaaaataattttaaaaacctcatttcctattcagaaataaatctcatcccacataattttaaaaatatcaatgttatagcatgattgtaaagcaaagaaaataaatggaaagtaatgaattataaaataatgagaattttggccaggcacaatggctcacgcctgtgatcccagcactttgggaggctgaggcaggtggatcacaaggtcaggaatttgaaaccagcctgaccaacatggtgaaaccctgtctctactaaaagtacaaaaatcagctgggcatgttggcatgcacctgtaatcccagctactgagggaggagggaggctgagggaggagaaggcttgaacctgggaggctgaggttgcagtgagccgagatcgcgccactgcactccagcctaggtgacagagcaaaactccatctcaaaagataataataattataatgagaattttaatatgtaaatttctaggcacaatgacacaattagacataatgaagtagtcaaatgcttgctcttatgtgagaaatcatatcttggcagctaccatccagacctacactatgtgtttcattaaaaacataagcaacagcgttgctgttgatgatgcaatttttccaaaaggatacagtctttctctcgtttgccaggcatttgcatgcctggaaaattcagaatgtgtaagaacaatgccaaaattgtttgcatttacataaaaacagagtgagtttcttggcttagatatttataaacaggctttcacatatactaatgaaccctaggacttgcaactcagaaaagtgttctgagaaccagcaacatggttctcaccggagagctggtcagaactcacaatttgacaggaatatttgggtgatgtaaaaacacagtaatgtctcagaagcactgccttacaatattgaggacattcactcaaaagcctagccagacaaaagatggttcttggttacatgggtattgtcatgacattgcaagaaatctggcttccctggttgctcactagagggccataccccattatcctaacaatcaaaaacaccctcagaacacctcaccagaggccagatatcccactgtccttataaacaaaaacacgcctctagggtgttgcacttcctttttgagaaccatattgagtctgtgtgcagagatttctcacaatcctaatttctgttcatgcattacccaatactttatttttctttacaggactctataatactacatatcccttaataccatttagaacagaatgttagttataaaatataaaagaaatgaaacgaaaatctcaaaaaaatatttgggccaggcatagtggctcacgcccgtaatcccagcacgttgggaggccaggacaagtggatcacctgaggtcaggagtttgggatcagcctggccaacatggtgaaaccctgtctctactaaaactagaaaaattagccaggcatggtgttgggcacctacttgggaggctgaggcaggagaaccgcttgaacctgggaggcagaggttgcagtgagtcgagatcacaccactgcactacagcctgggagacagagtaagaatcaatttcaaaagataaataaataaataaataaatattaaattaatagaaataaaattatttacttaaataaatgaaatatagctataaaattataaaaataaaatatagaatatgttataattatttttcttattatgctattttgggttattgaaagatgattacatgatgttgaaattccagaaattaccaattaaagtttccaataacttgtcttagcaattcaaagtgtctataaaatctctaaaaagaaagcaatgattggctggatatggtggctcatacctgtaatacaagctctttggggggtcaaagcaggaggattgcttaaggccaagagttcaagaccagaagaggcagcatggcaagacctccaactccataaaaagtaaataggaaattaaccaggagtggtggctcatacctgtaatccttgcactttgggaggcagaagtggaaagatcacttgagcccaggaattccaggctgcagtgagacactgccttaaaaaaaaaaaaaaaaaaaaaaagtggtgacagccatttggttgttggcatgcaatgtctacaagaagaaggcagaatttcaaagcaagggttgcaggccagtgttatacagaaacatactatgttagtgtgagggtacaattttgaaatttcaatctaagagagcagcatttcttagctccttgtattttccatgctataatatgggcctacgaatcccagatccattaaaattttaatgaaagtgaaaaatctaaatgtttattcaaaaacttctgattgttataacattagcaacaaatttatttttttaactaattaatatagtactttacccaaacaaatcaagcagggagattctaaaacctttttattagtatttcattctgtaccattatagatttgacaattaggtcaatttaacataatgtgctattttctatacatttaatttgagaagtatacagtaaaaaacaaacaaacaaaaaaaacccatatatttttggtttgtttgttttagagagatggtctttctctgttgcccacactggagtgcagtggcccgatcatagctcactgtaaaactgttattaacacctgggctccaaaaatcctcccttcccagcatcccaagtagctgggactactataagtgcactccaccatgcctggctaattgtttttattttttgtagagaaagggtctccctatattgcccaggctgttcttgaacacctggcctcaagcaatcctcctgactcggtctccccaaatgctgggattactggtgtaagtcattctgcccagccagagcctgtattaatttggtggttacatatctatgttcttaagaatatgtaaatattttaacaatagattaatagatttctctctattgagaaagacactattatataaccatatatatgagaatcatgtaataattccaatactgttttaaacaagtcatgctttcatattgagtaaaatttgatcaatggatgctggaaaacctcctccctcaagattccagctttttcagcaggaaaaaattaataaaaactttatatattctcttttctgttagtaattatgaaaaaattgcaagaaaaaatgtgttttctttatgtctccattatgtaaggctacactgaagtaaattattgcttgacatattcaatgattcagaagcaaaataaatgtagttctaggagaaagattggattgcaataagaagggcagcatgactttactgaaggcaaaggatcaagtgcactaggaagatccactcatgtatgttttccgaaactgtatcttacatgattccgcccactgtgctgatgcttcaaaagctgcacattgtccttaaggtccttaacctaatgaccatatctttcaaataccaaattctaaggacttgaaaaatatcttggcctacgttactcagtaaataatcctttaacaaacaagcactttttttttgacatttttattgctaacatatgttatagtcaaataatccccaaactatcttattatattttaaattttcctcttaggttctaaggtattttcaacatattgctttactaacacatggaatttagaaaaagacaaggtttattttatttactaatataatccaaattataaatatagaatattttcaagaaaaacaaatattttaatacaaataaaaacaacacattttcaagtatgtactaacaaaatgctttattcttgtgattataattgtaaatgaaatttataattgtaatgaaaatcataattgtaactaaaattgtaaataaaatttaaattgtaaatgtccatatgaaaaaaagtataaaaatattttaaaatgactatgaataacatgcagaatacttttgataacatctttttagaaattatcatcatgaagttttattaaaaaagagcaaatattagggaaatataaatgcactaagattaaagatacagaggaagaaatctaatttcttcatatataacatagaatatgttatagctatttttcttattatgctattttgggttattaaaagatgattacatgatattgaaattccagaaattactaattaatgtttccaataacttgtcttagcaattcaaaaagtctataaaatctctaaaaagaaagcaatgattggctggatatgctggcttatacctgtaatacaagttctttggggggccaaagtgggaggattgcttaaggccaaaattgcttaaaaatccaaagttttaaggaaatccataaaataaattttaaggtttatgttttcaagttttacaaattatttcaacaattatttattaagcatcttctacgggtcaggtactcctccagctaataaaaatgctgtctctttattgaagtttagctttcataggaatgaggaaagaaaaagaataaggacaaggaagtatggaagatgtccactgcagccttattcacaatagccaagaaatggaaacaacctatgtttctgttgtcggatgaatagataaggaaattaaatataaagttcatccttgaacaacatgggtttgaactatgctggtccacttatatatggatttttttcaaacaaatgcagatgaaaagtgcagtattaccagaataggaaactcaccaagagctgacttccatgtagatgggttctgcagggctgactgtgggacttgagcatcaagactttggttcacgcagaggcccaaaccaatcccttgcacataccaagaaacaattgtatacagtggaatattattcagctataggagaagatatcttgccatttgtgacaagatagattatgctaaatgcaattagaggaaaacattgcatgtcttcacttatatgaggaatcttaaaaagtcaaatacacagcagcagagtagaaaggtagttatcaagggtggagaggtaaggaaaataggggtatagttaaaggatgcaatgttatggttgtccataatgagtgagtctagaggtccctgtacagcattatgaccatagctaataattctgctggtacattggaaatttgctagaagagtagattttaggtgttgccatcacacacacaaaaaggtaactgtgtgaagagatgttaatttgtttgaccatagtagtgatttcatttgtgtatgtatattgaaacatgttgtatactttaaacatatgcaattcttattaaaataaaaaaaatagctagacaagatgtaaaaatgaagtatgccaaagtgtgagaccctgagttgaagatccggaactcatctctgactcttagactcagagactgggacatcaaggattgggcagaataggtatgaccatgagtattttttaacagccgctacaagtggtatacctagtacatatgcagcagacacacaactatgcctggaaagacattttggatgccattagtttagtaatagtcctaatattggtaaattagaaactcggtgtggaaactttcttgattgtgtctatgttttctataaacaaacaaaaatctgggtatataaaataatagtttcacagaattagtgttctaaagagctgacatcgttagacacgttgacttgtttatctttttatgtatatcagcttactttgggcctagcacataataggtgtttcatgaatgtctggtaaataaataaaaaaataagtaagtgaataagggcacacataaaaaattcagacattttttgttccttagaataactgacattcattgtgtatggtttatttaaaacagcacttttattgactctcttgtacgtcataattaatttcaaattcaacataacatttagattgtatcacaggtaaatataaaaattaattgcttgttgatatgagaaagtggacaagagtgggccgtgtttagaaacctcacattttacaactaggagaacagaaaattagaaagttaattcagctgaaaacaatactgcgcttgctcttacagcagttatatggtgactgggggaagcccaaacttgataaactcttacttaaaagacagccgtaggacaattacaatataactttaaatgcatattactcaaggttttacaaaactatttggatcaatcagaaacaaaacagcctttttgtttctacataccaagaaatattgcctgaagatttggaatgttcatgttttaatatacatatacaaatgaaatgattattatagccaaacaaattaacatctcttcacacatatatttggaatgaagtttcatgtcgggaagacagcacaatagaattatttgtgtagtgtaaatttttgaaatttccaatttgtgcagagcctgagagataaaatattcttactctctcatgaaatagaaaaggaaactgaagttgaagtagcttgcagaagatctaatagcaagttttaaaagaaatccactgctagaaactaggtttcctgacttccaatcgtgttatttccaatgcatttttattttgcagttacatacacatattaagaccaaagaactgaaggcattctcctgactctttcacctagaaacattcttgtcattttccctcaaattagaaacagattatacaacttttaagtatttagccctcctgtcagggtacctgtatactgtaaagatgttaaattcgcaaaactaatgtgccctccttttgagcaaaggtataaggagatgaggttactgatatgcctgttatgaaaaagtagtcgtacgcaaattgagacacagattcagctgtgattgaagcagtaagttgtgcagaactattatctgtctcaccttcttatgaatgacctttcctattgataaaagaccttgaaatcatttcaaaatgaaaatcatcaaaagacacacagttacaattgaccatttctgatatatccacttttagggaaaaatagaacatcaactatatcagttttttcatgaaatctctgcataaaatatgagtcatgaagcatttcatgccacttgtgtggtatttataaaataaaagatccaattagaagtgatgaatgtccaatatacttagagaaatcacatcttcatgaaaacatgacatgggctatagagaaaatattccatctgcggaatgaagcagaacatactccaaatttaaactagaataggttacaatagtatgaatattacatacatatgtgctttaaagaattaaggcatctgttacatttattttctatttctttgtttttagacaggggtagactttaggttagtctctttgcctgtagatgaatgataaagaagttttggcctcttcataggcacaattactgttacctgtgtttaagcttggtacctagcaacagaatcggaaaatttcaagacacatgcaagtgggctgcttgtaagagcatttgcagacttcatctcatgtgtttattctgcagtggtcaatggagctacttaagagcttgcatatttacctagtcatcggtgtcagcaacatttagaatgggtagtaatatctgcattcagaaaaccaaacttctttctataacccaaagccagaatacaattaagattatttcagtcagtcaatgtattagagttttccaaaggaaaacaaaacaaaacaaaacaaaacaaaagagtaggatttatccaaccaatagaatgactgatatcaggaaaccttggtactaggaatgtaaaagaacttattcaaagttgcacagccaacaagtcatacaagtaagatgcaaatctcaacaatctggatccagaatttgtactgtgtatctctgaaccaggaactgacactgatatttcagggaatagacacataggtacatgttcccacaaaggccaaaataactatcaaaagcagataatgacagcctcacagaagcaggatttctaggcctggatcaagccagaaatagattagtttgagaagcatactgtctattgatccaagactgcaggaacaagaattgattgttcatttggagagaggggcagctcacagaataaaaccaaaaaggaaaagctgactgtggtcattttgcttgagatgttgttgattcagagctgattcagattatttttaatctaatgttcttcctcacagccagataatgacatgcctttttcttacttcatactctaactttaaacttcaagttggcaaactctaactctgaaactaaaacacatatcatctgttttaaaaggcctgtgatgactctgtttcagtggcagctatttcagagtttttatattgagagattttattttcttctttggccagttttactcatatcaatgcaaaagaggcattaattagcaaagataaacctcttttttagtgtggtcaatagatctaggctcattagaaatgtgaatgtacaaaagatgaccacttaacttctttctagaaatttcatcaaaagtccatggcagcattttatatggtttctattactactcttatttctgagccttacttttgagaagtcactttaacaacatattttatgacatcaacaaaaactatctcagattaaatctccaaatagtgtaaggcctctatggagaaaattttaaaagtttatggaaggacattaaaacctaagtaagtagacatactatgtacatgaagagtaagacttaatatttaaagttgctaattctccccaaatagatctataaattacatatgactccatttaacccccaataattccccaccatggaaatggataacttcattaaaatgcctatctatatctacatatttctaaaatatcaatatctgtatatttttctatctacgtaacagaaaaggacaaataagagccaaggcacttctagagaagaacaaagaaacacgtaacagaaaaggacaaataagagccaaggcacttctagagaagaacaaaggtgagtgcgtgtctctgtgtgtagaggcgggtgcatggatacttgcctctcagtgtaacaagtttaaaaagtgaacaaagacaccatggttttggtgcaagcataaatggatagattaatggaatgaaaaagaaccctgaaacacacatatacatatatggaaatccaatatgtgacagatacggcgttggagattgatgggggaatggtggatttttcaataaatgatgatggaataatgaacaagaaacatggcaaaaatgaaaatgaattaatacttggcatccttggcagattgtattttccaaaaatgactactgtaacatttctggttacaaatgcattcccagaacatttcacttattaagaggtaaattctaaatgtgttctaaaaagtaagcacactcatataattatataatagtaaaattatcagaatcaagaaattaacattgatatactagcacgattttattgttctttttcaatttttaaattgaaatttaaatttaaaaaaaagtaatactttgctttacatcattttttcacaattatttacttatagtattataagtaaactcatgtatagttatttttaaatacgttataatcccatttgtcctagattcggccagagaaggctccttccagctggcttctatagcctttggcatgttctctcatcattctttgaggaatttcttgtattttggcacaatcatcagagcaatacttgattcgtggtccccagtctagtcatgtttcatataattgtcatgctttgctagtgttccttcatctgcaatatttccaaagtcttgctttgtcttttaggacattgggattgtttaagagtacagacctattactttatagaatgcttctaaatttatgtttgcctgatgtttcatgatgattaaattcatattttacagttttgggggaatgccacaaaagtggcatagtaacctgttcagtgtataaaaaaggtcctttgatgttgatgtgtttcattgctggttaactttgatcactttgatgttaactttgatcactttgatgttaactttgatcattcagttaatgtggaatctgccagttatttttcttctactgagcagttactaatactccctttgcaatcaataagtactctgtgggagactttgagatgaaacaaacatcatgctctcctctgacattgacccatgaagtatcccagaaaattatgattcttgcttgaatcaaacattgctatgataattgccaaatggtgactgtctaattccattatttcttctgcatctgttagttggcattctactataatgataaaaatttctcttttttctatttgtttatttattcaagtactcacttgtattttataagctcatggatagttatttttaaataggttataatcccatttgtcccaggtttggccagggagggctccttccagctgctttctataacctttgacaagcactctcatcattcttgaagaaatttcttgtattttggcacaatttttagcttatttgtacctagtcccagccatagaaacagtcatttctccaaggatcctgagttcttttaagtgaagaataatatttggaaataaagatctgagtactctaggtgttttagcaattttaaaataattaattacaaaagctctgatgtgttctcattgtctttcacttaataattagacttctttttcttgtaagatttttttttccttttctgttgtatatatttaaatgagatgtgttttcttgtatgtggagatggaagtttctgtgtacacagtggggtgaaaacagggtagcttccctagcttcctggattaaggacaacatttgcccttgtaataatgaatattggaaattatggcctctctgtgtagccacctgcacaattttgggatctttttcctctggatgccttttaccactatcaaagctgctttcatctttactcctagtgctctgttcctattctgctaagtttagagattaccaacagttacctgcccccgttcccacccccagtagtttcctctctccttctgaatgattttttttctgatatttctgaagtccctgaaaattagaggacgacagaatatgctgaccttttaataaacgctttgaggaccccaggttgtttgtttgtttatactaagtcacatattgaagacagtggagcccttcccattgtcatcagtttttcctcagatctgccactgaaaattcaatgcagagtgggatcctctccttttcagaaaaaatacatgttaattacttgggaactttcaaatacccctttctcttttctgcattacctctacccgtcactcaaaccctgtgggggctggacacagccctcattggttctgattcggcccatactgtctttaggagttttgctttgcctattctgtcttttatgcctgtttttgtcttttttaacaaaaaaaatatgaggacagtcaaaaactatactaccatattgatagtctttttatttatttatttatttatttatttattcatttattttgagacaggttctcactctgttgcccaggctggattgcagtggcacaatctcggctcactgcaccattcgcttccctggttcaagtgattctcctgtctcagcctcccaagtagcagggattacaggtaagtgccagcacgcctggctaattttcatatttttagtacagatggggtttcgtgatgttggtcaggctcgtcttgaactcctgatctcaggtgattctcccgcctcggcctcccaaagtgctgggattaccggcgtgagccaccgcacccagcccatcttggtgtgtcttctatcacaatttgtcttctatcacaatttgtgattgaaatatttaaactgtgctttctgcacttcttgtaatttatatttatatttataattacaagatgtgcagtaagcgcagtttaaatattttaacatttaaatttaaatattgcatatttactgtagtggcttatatatttcattttctagtttcttttgagacttttgtgaaatacaactattgctataattttagaatattattaattatgttaagtgaaaaatagtagtgataacctaaaaatagggtaaatgatccttcccatttcacttctataacattatatctttattaaaataggccacgttctaaaatgtaccggtgcaaaacttgtttcttcggaatactataatagaaggcttattcattcagactaatcaaacatctgggcaagagagtataataaatcagtagaatatctaggccatcctgagaattcaccatagctccataataaataaaaagcatttccctttcatttttcaatcatttattttctttgtacatgcagaatatcaaaggcatttgtaaaactgctgatgcttttgatttacgaatgaagcatgcgcaaggtaaggcagttcttcccattatgtatttgctgtttatgtggaagtaatatgaccagaaaatcaactggaacctatgttcgatctgatagaagagactcattataaggtaatattttctcccgtgtcattttctgtaaaattcaattctgacaataaaaatgaaagaaccataaaaattattctatttataaaatatagatggtataaatacatgtgattacatctaagtgattactgatagcaaatatagaaaatattgatttggtattctgtaacttctttcagttttttaaataagcagaattggtggaagttttcagaaatgataatcatatgtatggtgtagtgtagcaatttcatttaagctgaatggcagccctaatgcagtgaagattttttaaaaccccacagcgacatcatatttctatacaacttctatcattatattttctttctttttttctttttttttttttttagacggagttttgctcttgttgctcaggctgcggtgcaatggctcaatctccgctcactgcaacctccacctcccaggttcaagcgattctcctgcctcagcttccccagtagctgggattacatgcgcgtgccaacaggcccaactaatttttttttttgtatttttggtggagacagggttttatcatgttggccaggctggtctggaactcctgacctcaggtgatccacccgcctcggcctcccaaagtgctgggattacaggcgtgagctgccgcacctggcctctcattgtattttctattgttaaattctagtaaaatgctgactaagaaaatatttaatgtaagttacgtttataaatgttatccacattattcaattagattcaatgttatttattctatgtacattaagatgaaagacaatgatatacaagtgtcttttgaaagactcagaaaaagaatcatatgaaaatatactgcttttgccaatcttaaagatatggccacaatgtggttttatgccttcaaagacttgaagaaaaactggggaatgaggttgctgggggttgcagagaacagaaaaaaaaatggaattgcaggaaaagatatgatgcactttcctcaagtatgttgtcagagggtcataaatatgcacagaatggatatggaagtaagtgagggtatcctgtttggtttttttttttttaaaccaacaattttaaatttttctcactagtctgtttgtaggtagttcaccatctgtaaaatgacttaaaaggaacatgaatatggaatgtgtgcaggatgtgagtgccctatttacaaaacaaattggtagattgcatttggcttactctgagaaacccaaataaatatgttcttttagaatttcacttattctgttaataaactaaaacaaaacagtcctaaaaacataaaagatgaagtcaaacacaaatatcaaatctggaaacacgaggtggtaagttttttaagtgaacttaattgcatgggttataaatacttttctcttcaaaattaggtcacccttgaaaacaattcaaattagaaggacttgttctgtatgtatattatccagaaaacttcattaatgacagtaatttttgccgcttttgtttcaagatttacatgttttcactagaataattggaccagaaaattaaatgcctggaagccaacaaaggtttgaataaattgtgaaaatgatgattgctttgttaaaaataaagacttcaagaatacattaaatcttcattgtatttttcatctctacttaattttcctatgtagtcaatcaccttcacattttaattatttgtatgttcgtatttaattcatctaaaattatatttacagaggacgtgaagttgaaataacatttagactaatgccatttattaaataagatattctttttaatggttgaaaagtcgtttgtcacctattaaatttatgaatttaattattttcaggattcccaattcttttctaatgattattttgtgtacttttatttattttgtaatgaatatattgcattgtagtgagggactgtgtattaagtcagggaactttgaggcaaacataacatataaagagcccgtaactctaactagcacataataaaatcttagcaacttttagctatcattacttttgtgattgtaattgttaatagaatttaaggtttccaaggaaagacaggcagttgacatacaaagaaagacatcattttccgaggaacttgtatatattttggacttgatggtatttcctacaactttattagggtgtaattgatgttcaacaaattcttatataatttaggtaattatgtttatacatgttatatccatgacactctcatggcaattgagatcacaaatatatcccaagagcaaaatgctttctgtcactttagaaatgcacttaatttgcattttctggaaatccatatacatgaaatcatgtagtatgtaagtacatactttttgttgttgctcttccagcttcttttactcagagtaattattttcagattaatctaggtttttggtatattaatagcttattttttattgctaactagcattacattgtatgcaatatccatttacctgatggattccagtttttcttccagtatttggcttttacaataaagctgctattaacattcatacacaagtctttcgtgtgaacatgttttcatttcttttgtttctttcctgtctttcaagggtcattctcatgccctgtcccatgtctgaaaataacagtttcatatagtttgttcagcttttaattggttgaggtggaagggcaaattcaatttcagttattttaccttggctcaaagtgggtccttatcccatattattttcgtgagagacccttcattgatttttagttatagtttttcttccaataacaggttaaattccatgaaggcagcaatatttttctctgctttttaaactattatttcagttccatatgaaaagtttctaccactagttgaaactccatcaatattggttgaattaagcaaaattaaatgaactcaactaataggggctaaaaacacagggaaacatattctttctgcacacttcatgaggtaaaaatgtgatttgtacactcagcaatgctattcaagaccctgacattacatctatttcactagatttaatacattgaacttttattatgacacttaacacttcataagcacaatatggtggctgtaattctacacctcaagtgcttatgttagttaactcatcaaaagggagaataaagtaaggagaaatgggaggcagcttggttttggtgtaaaccctcaatctaagaggaaatatttttcccaaacttctaatcttacttctccttacatctcattggacagatgtagttcacacggccactcctaacagtgtggtggctaggccattcctcacttttgtcatctggagagtggaagttaatcaatgggaaaagtgtgggaccacctattgtgtaggcatctaaaatgaaaatttaaaggaagatgctgaatataattgacccgaaggtagtctttaattattatttttcaatgtttagcaaaacaagtgggcaatgaggagcttcataaaagtcattttgtctaaatttcagaaatgataattgcagaaaggaataataataataataaatgcagaaaggaatctcttagtaaggcagaaagatggagaattagcctcaggttacaaacttttgagtaagctgtaaggattatctggcatagcaatgtattaaaaatagaaacattaagaaaggttttctggtgaacacaataatctaattcaacaaatgtctaaaaaaagatttatgatgtaacagatgaaacagcaggtatagaatagtatagaaaaggaagtgattaaattcattattaagtgacgttatcaatgcagtttttttttcagaacaagtaatacctaaatatattttgaggattgcaaatgcactagacagagggtggtattcctttagctgtgtgtatagaaatgtaaacaaatgttgcaagtgtatatttatgtttcctgattaacacttccatccttactgtaacataaaagggcatttatgaaataaactttgcaaatctctctagaagcttctattgcttgaaaatatagtatatatgtgttggtaaacaggacatgtatttgaggggattaggttagaaaagtagccattgattggtttgtgaagagtcttatataccctactaaatgtctaggatgttaatcaaattaatgtaaattaagagattagtgaaaaagatttgcattttttgagagataacattagcaataatgtaaaatatttggggaataggtaaagggaaaaaaaggaagctattgtgagaaatgatgaggctctgaaccaaagctctcagacaagtagtgtcactgggaataggaaagaagataataatgaaaatatttaataatttattagatgtaatggtgaacattttagtttggttatctacaaatagcttgaaacaaatgcttacgtaattgtatttggtgaggttgtggtggggctgtagggggtgtcatcccggggaaaaggaataaggatgagaagagaaaaatggggagagaggggtcacactctgagtcggcctttcctgtgggcaactggttgcttgatcctttgaaacccttaaaaaaagctgacgggcgcagtggctcaagcctataatctcagtactttgggaggccaaggcaggcggatcactaggtcaggagatcgagaccatcctggccaacatggtgaaaccccatctctactaaaaatacaaaaattagccgggtattgtggtgtgcacctgtagtagtcccagctactcaagaagctgaggctagagaatcgcttgaacccgggaggcagagactgcagtgagcccaaaattgtgccaccgcactccagcctggtgacagagcaagactctgtcaaaaaaaaaaaaaaaaaaagcacatggaatatatcttaaaattgtcttttgtagagggtagagaaagaggcaatcatttctctattaggtcacattccccattgctcaatgtttagctaatccatggttaactcacccctttctctgggttgtgcatgcactggcaaagagtgggtttctataacttcccacatcagctggatggctgaggagggctgcagcaccagaaaaagaaaaggtgctaagatggtttgaacattcacaatggctgaaagcagagacagatgagagagatcaagaggatgtgcgttgatacatcagaggcgtctaaatcagtaaaggagaaaagtacacacagaatgactatggaatggggaagcctcaaagagtattaaattaacatgacaaactgatgtgttaaaatgtttgttgttgtactcttagaaatcattatttaggaaattatgtgtttgtgatattaggtggggtggctgctactctggcagctgagttgcagatgggaggcagacaatgtgagatagttttcctacttcccaaagttggtgagcactttttctctttcactaaagttagttatttaggcttctaaacagcctttctaagaaaaagaaaaaaaacgactttcaaatcataaaatgtgcccatggaaagctgttttcagacactatttgggattctttttaccaaagaaagtaatcttcatagcagaactctaagcttaaaagttattttgctttgagattcatctctgaatgttgctatgctaaaagaaacttttacagaacaagaataaagcttttaaacttcacacgtagccacagggataccttcctcatgcatagccatggggatatccagggcttcaatgctaaggaaaaaaggcagcaaatccctctacccaccgtaccatctggaggacatttactagactgtcacacatgcacacacacctggataagagcctgtgaacagtgtcggctgagtaacaacgtggagatatttttttttcttgacagtgtaattgaaattatagctataatatgcttttaaaaacactggattttttcttatatttttttaaattttaggtatttattcacttaatatatttttgaaataaggaatcacacaaaaaatgaaacttatgggaagtcttcaggcttaatttcctaattgtttgatcactaaaaatcaaggaacctcaggcagttaccaagtaaagtcacgtacgtatttaaaccacctacttattatctatctataaattaaacttagaatatttaccagctattctgtaaattcgtatctaggcaaataagtgagtaaaaatattttgagcagataagacaatgtgccccgacaaaagaggaatttaaattcaatgtagcagcattagagttttgagggattacagaaaaattagactagaaaaataagcagaatccaaattatgaaagatcttcaagtcatatcatgttgttggaagtgtctaaagtcactggcagccactaaaatgttttaataatgacaattaatctgattgcttctaagcaagcatgacgtgggaaaaccagttgaagacatttaggtaccctggagtggtgttggaacagaagcctcagaggagaatcttggggaaggagtgatatgtgagcatctacaacactctctaaaccaaaaatatatgaaagggacgacagaattaggccaagtctctaaaggattaagacagaagtattaaaaatgatattcttcttatcttgcatgtgtgcaactgattttaaaaaattaattaccacccccattactgttatattacacacagttttgtagcttatattgatcacattgtgtggccttctagattttgagactattggacaattattagggcccactattttgttgaaaatctaacttagggttactgcaattcaattctgctactaacaacttaaagtaaatgcagactccacaagttaatgaacatagtccctaagatgacccttactcagactccaattgcactatgggtgttctcaaattcagggttccagtgattctccaaggcttggtaattctctagaatcactcatagaactacagtttattttaaagaaaaacacagggcaaaaaataattgacaatgtcaactaccagcagaaatatagacaaatctggactttcaccagataataggaatgtatgttaaaacaactacattagaaaaaagtatggcatttttacagagtttaagatttctctcccctatgactgagcaattccactcttagaaatacactcaagagtgagagagggctgagtgagacagtggagtaggtccttccagaagttattctcccactgaaacagcaatttgaacacctatctccacaagaaaaacccttcgcaagagctcagaaaaacaggtaagagctcacagtatctggttatagtgtaataataagaaaagatgtattgaagagggtaggaaggacagttttacattactttcaatactctttcctcaaactcaggcagcacagcattgagaggaatgtggtatacttgggaaaaggggaggaaattagcatggaattttgccttggaacataagaccggggccaacacagtaaaatcaagcactgggcataaccccttggcctctgacaccaggctgctacctccagatgaagcctctagacctgccccagaacccagacataattcagcctgcatcaccacttacaaactacagcagccttggccctgaataaaccttagtgccaggcaggctatggcaccaaggaccttaggcatgctccagcgctgtactggtctcagagttagtgggcatctgctgtgacccaatgttgcattagcctcagcagccacaggattgccaatgccacctttagctcatccccaggcagcacagctggagagagacactgtcttcttggggaaagaagataaaagtaagcataggactttaccttgcaacccagtacaggcctgcctcagtaaaatctaacatgaggcagaacttccccaactctgacactaggccagtacccacagatggaacctcagaccaccccagcaccagatgggattctgcaatcccagtaagacaaattcatgctccagttcatattatggccagctgactacattgacattttccttaaataaacttcaagctatataatctttaggacttggagacaacctgcactgtgcttgtcttggtgaccatgggctttgggtgtgatccagcgttgtgtcagccttggcagcaaaaatatttaggccacaatggtatatggttaggtgtcttctagcattgtaattccggaagcagtcacaagcttagggttctcactaatcaaccttccctgaatctgctaataaggtcaacactgaagaaaactcccaaacaaagccacactacaaatattggatcaggtgcctactccaatgttcagaaattgatgtagagccacaaggatcaagatcaatcaaggaaacataacatcaataaatggtcaaaataaggtgccagtgactcaccctaaagtgatgagacagaaaaactgcccaaaaaataattcaaagaagctgtttcaatgttcagcaaactacaaaaaattacagaaaaacaattgagagatttatcagagaaatttaacaaagagattgatataataaaaaaagtagaaactctaaagcttaaaaatagaatgaataaaataaaaaaaaaataatagagagtatcaacagcaggattgatccaaccagaataagaatctgtaaacttgaggtcatgttaattaaaaatatacactcagaggagaaaaataaaaagaataagaagatatgaagaaaacttgcaaaattttcaacttcaacatcccactttcaacaatagacaggtcaccttgacaaaatatcaatatagaaacatggtatttaaactacactctataccaaatagacctaacatttataggccattctttcaaacagttatagaatgtacattcttctcaaacctagatgaaacattttccaagatagatgacatgttaagtcacaaaacaagccttaacaaatttaagatcaaaatgaatgaaagttaccagatttagtaaaataacatcaaaaagcaaatttacaggtcattattgttctagagagagtacagaaagagggatagagagcttatttaaatagttaattacataaaactttccaaaccagcaactaacctggaacgggaaggtcagaggtctccaatcaggttcagtctgaaatacgaataccctaagacatattttaatcaaactgtcaaagatcaaagacaaagggataatcctgaaagcagcaaaagaataaaaaaacaaatgagatataagagagttccaacatgtctcacagcagtcttctcagtagaaaccttataggcttggagagatgagataatatattcaaagcgatgaaagtaaaaaaaaaaaaccctaccaatcaagaatacagtatcagcaatgctgtctttcagaaatgcaggagagatgaaggtttttttggacaaacgtaagctaagaaacttcctcagcactaaacctttcttgtaagaaatgctaaaggaaattcttttaaataaaggaaaaaggtactaattaataacatgaaaacatctgaaagtatataattcaattttaaaagtaagtagataacaaaattctaaacagtctgataatgtattggtgctgggtaaaccttaatatgaagttaaaagacaaaataattacaaataataactacattaatttgttaaggtacataaaatataaaaagatacaaattatgacattaaaaagtcaaaatattgggggaagaggaagagtggagttttttctcttttttaattttcttttgcaaagttaagttactgtctgtttaaaataacctactaaaactatgagacgctttctgtaagcctcatagcaattgcaaagcaacaatatagaagaaatacactaaaaaattaatcaaaacttactacttaaaaaaaattcttaaccacaaaggaagacagtaagagagaagtaaagtaagaaagaacctacaaaacaaaacaaaattaacaaaatggaggcagtaagtccttacctatcaataattaccttgaatgtaattgaattaaattatccaaataaaggacatactgtgacaaaaggcataaaaagtgaaaactcagctatgtgctgcctacaagagacaaacttccccttagggacacacatggattggaagtgaagagatggaaaaagacattccatggagagcaggagtagctttatttacatgagataaaatataccgtaagtaaaaaatatgtaaaaatgagagaaatgatattatataatgataaagatatcacctcagcaagagaatataacaattataaatatatatgcactcaatattggagcacctaaatatattgaacaaatattaatagagctaaaaaaagagatggactgtaatgcaaaaagagcaggggacttcaacatcccgctttcaacaatagagagatcaccttgacagaatatcaatacagaaacatggtatttaagttacactctatattgaatagacctaaaaaatatttacagaccattctttcaaacagttatagaatgtacattcttctcaaataaagatgaaagattttccaggatagatcatatgttaggccacaatacaagtcttaaaaaatttaagatcaaaatcatatattctcagaccacagtgttataaaactagaaataaataaccagacaaaacatgaaactttacaaatacatgtaaatcaaacacatgctcctgaacaatccacgggtcaatgaataaattaacagtgaaattaaaaaattccttgaggcaaatgaaaatggagatttaacataccaaaacctatgggacacagcaaaagcagttctaagagggaagtttatagcaataaacatttatctaaaaaaaaagtcttaaattaacaacctaacattgcacattaaagaagtagaaaaacaagaacaaacctaaacctaaaactgatagaagctagtaaatcgtaatgatcagaggagaaaaaataaaacagaaacttaaaaaatacaaaagaccaatgaagagctagttttttttttaattgaccagataaacaaaatccacaagtttttatctacagtaactcagggggagaaaatatatagttccctcttagaactcagaacccaaacaaataaaatcagagatgaaaaagagatatcacagctgataccacagaaatgcgaaggatctaagagactattatgaacaactatataccaacgaattagaaaacctataataaatggaaaaatacctgcacatacgcaacttaccaaaactgaatgatgaaataatttaaaacctgaaattttgaccaatagtgaataatgagattgaatcagttattaaaaaatctctgatcaaagagaagcccaggaccttatggcttcaatgctgaattctaccagacatttaaatgaaaactagtaccaattattctcaatttattctaaaaaattgtagaagatgaaattcttctaaactcattcttagaagacagttttaacttgataccaaaaccagatgaaaacccaaagaaaaatggaaatcacaggccaatcttccagatgaacgtagatgaaaaaactctccacaaagtactggcaaactgaattcaacagcgaattaaaaaggtcatttaccatgatcaagtggattcatcccagagacgcaaggaagactcaacatatgcaaatcaataaacatgatacatcattaacagaatcaaagacaaaagccatataatcacttcaatagacataaaaaagcatttaataaaattcaacgtcccttcatgacaaaaagtgtcaacaaagtaggtatagaaggaatgtacctcaatataataaaagctgtatattacaaacacatagctaactcccagatagcatcatactgagcagggaaaagttgaaacttttcttcacagattggaacaagacaagaatactcatttccaccacttttatttaacatagtactggaagccctagctgggaaaataggtgaggagaaaacaaatgaaaggcatccaaattggaaagaagaaaatcaaaatgtctctgtagacaatgtaattttatatatagaaaaccctgtatacgccatcaaaaactgttagaactagtaaatggattctgtaaagttgcaggatacaaaatcaatatacaaaaaccagtactgcttctacatatgcataaggaactatctgaaaaagaaattgaaaaagcaataccatttataatagtgacaaaaataagatatctaaggataaatttaaccaaggaagtgaaagatctgtatactgaaaactataaaacattgataaaagaaattgaacatgacacaaataaataaaaagctatgccatgataattaattggaaaaaatattattgttaaaatggccactctaaccaaagtgatttacaaattcagtgtaatttctaacaaaataccagtgacattttttgctacaatagagaaagcaactctaaaatttgtatggaaccacaaaagaccctaaatggcaaaatagattttgagaaaaaacaaacaaacaaacaaacaaacaaacaaaaaacaaagcctgtggcatcacactatctgaattcgtaaaacactacaaaacagtagcaaccaaaaatgattcttgtgtaaaaacagacacatagaccaatggaacagagtagtgaacacagacttacagccaactgatcgtcaacaaaggtgccaagaacacatattgagggaaaatacagcctcttgaataatgatgctgagaatattgaatatacaggagaataaagccagacctcatctctcaccatatacaaaaatcaagtcaaaaattcatcaaagacttaaacgtacaacctgaaactactagaagaaaacattgaagaaacagagcattggtctaggcaaaaatttgtatatgtgtgtgtaagacctcaaaagcacaagcaacgaaattgaaaatgaacaaatgggattttatcaaactacaagtttctgcacagcaaaggaaacaattaacaaagtgaacagacgttatacacaatgggatcaaagatttgcacactatccatctaaaaattgattaataaccagaatatagaagagactcaaagaactcaatagcaataataataataatccaatttaaaagagacaaaaaacctaaatagatgtttctcaaaagaaaacatacaaaaagccaacaggtatgtaaaaaatactgaacattactaataatcagggaaattcaagtcaaaaccacaaagagatatcatgtcaccccagttaaaatggctatttaataaaatgctggtgacgatgcagaaaaaggggaacattagtacactgtgtgggaatgtacaatagtacagccattacagaaaacaatatggaggttcatcaaaaaagtacaggtagatctaccatacgatgcaacaatccaactaggtgtatatgcaaaagaaaagaaatcagcataccaaaatcagtgcggcatgtttattgcaggactattcacaataaccaagatatgaaattaacctaagtgcccattagcagatgaataaaggaaatgtggtgtatatacacaatggaatactatttaattatgaaaagaataaaatcctatcatttgcagcaacatggatgaacctggcaaacattatgttaagtgagataagccaggcacagaaagatgaataccacatgatctcactcatatgtagactctgaaggagatctcattgaagagtagaatagtagctaccagaggctggggaagggaggtgcagtggggattaggagaaatttgtcaacatgttcaaagttacagtagacagaaggaataagttctggtgttctattgcacattagagtgactatggttaaaaatattgtcttgtacatttcaaaatagccagaagagagaattttgaatgttctcattacaaagaaatgattattgtatgagatgataaacatgctaaatacactgatttggtttttacacaatgtatacatgtatggaaacatcacactgtatcctataagtatatatgattattatgtttgaataaaaacaaaattttaaaaagtaatgcctgatacttaacatcagaatagatattttacaaggaaaaaattatcaccattgttcatattaaccatgaactagaaatagctcaataactcaatgcccattctattccattccattcactcttctattctattctattctattctattctattctattctattctattctattctattctattctattctattctaattttttctaattgattctgttcttcatttgtatatagttgatattacacagcaatggaaattttctattgttccctacaagaatatgaatagtgtagcaccacataatacaggcaaaaacaaaacaaaacaaaacaaaattcaatgatttcatttatacattggaagttaacaccaaatctacattctattgcataacgttttacatatacttaggtggtaacacacaaatctaatagggggtgattttataaacatggtgaaaattgttacctatatgctaaaggcatataggtaattgagaaggattattctaagggctcctgggatactggtaatgttctgtttcttgaatagaatgatggtttcatggctgtttaatttttaataatttgtacactattaatcaacaatagaaaattataccatatgttacattttataatttagattaaaagtcaaatcatcatgtgtatactttaaaacacaattttaagtaacatattatctatttttagacagcaaattacataaatattttacccaagaagaataattaaggttgttagttaaaagtctatcctttattaaaaacatcacacatgcaattagcatttattattcctaaatatgtagcaaactccaatagtgtgaagatagattcaattttctttgtcaattttgtttcatgtacatatgtactatcagcagcagtagctatatttagaattaccattttctaagcattgctatatttataatgtctaatccactgtgtttaaaataaaataaactagttttaacaaaatttgaagctttaccaatgaacacttactctaatcttgtatatttctaggaattatttaagaagtaaaattattttgattaaaataattttcatgtcagagcagatgcttatcatttttattccagtatgttttcattatcgacagtttgtgtgttatatatacttcagtaaactacatcaaatggctcagaaacatgttagatatatttgctttaatttttacaagttacagaagaaaaacaattagaattgatttagattagattcaaaataatttggaaagggttacttgttcactagtgttatttctgaaataagtttatgctagagggggcttttggagaagactccattacaaaagcatcctggccccacgacccaacccttcttatgttgctgcccaggatcagagtgtgtcaaaggtggccaatctgaaggagctccaaatgtccaaagctgaataatgtgagcactgaaataaataatgctaatattgtaatacaagccaaagaataaaataaacatccatgccttggagttaatataaataaaaaaatgaaagcagggagaaatcaaaataatttatgtagatactttcctcctccaccaacactaccaggaggtaatgtttttccttaagtgtgtattccttttccttgagtgtgtattccaggattgtcctgtatattccctgtttcagttctagaattagccatttctccaaaaaatcctaggttccttttactggagaatggtatttagaaatcaagatttgggcactgggtatgtttgtggctgctagatgttcactgctcccatactacatttcccagactgaagaaatgtagataagcatcctaatttatatgtatagacataactataattagttctgttaaacgtgagtttctactgatgtctctgactaatccatcactgtgtggttcattctagtattcctctcttgtttatttgtaacttatttctgtgacattgagaaagctgtcttccattttctatagcatatttacttttcaaaatcatccctagatacatataaagtagtttcagaattgctaacttgtacccctttgagaaacaaatttacccactagacagtagtgattttactcccttattctagtttttgactttttaaatccaagcaaacttgatttaacaaagttactttaagccagtttcttttctcttagtctccagttgaggttatatcatgtgtttgtaatacagttagatttgtttgttgcagtctgcattccatcctgggatcactataacttctatcaattagaaaaaatgcatacttgaaggttcactttgtataaatctacaggagatacatggctatgcatataatatgtaatttaaaagtaaatttgaatcaagtggattttaaaaagcaaaacatacaacttactataaaaaagtacaaaattaacctaactatagatgaaataaaaacaaagttatacatgcacccacaagcagaaatgaattaatttatggaactctggagcaaatatttcagatttgtacttttactaagacaaataatctgccagacaattgtgatttttacttagtttttttttttttttggtggtattatcaatataatgattctagaactattttgtgtacatcataagatagaagaaacaagtacatttagtgatattgccaggaaccagcgttttcactatggcagtaggaaagtaaacatatgtaatgtcagaaggaaaggaagaatcctgtgatattaaactggagttggagaaatcagtccaaagccatgatcctttaccaaatgtcttcacagtgctgtccactgaaggaacctagaagagtaacacagaagtagcaatgagcatacatactgcccagatcttggtgtgcaaatcccatctccaagtaaaaggaactagggctcttatttaaaaaaaaaaattatttagttcaaatctagggctgtaaaaaataaaataaaatgaggctggaacatcttatggggactgaaattaagaaaaatggattgtatcaaaaagactctatagtcagcttgaatggcttctttcggcccagtttgggaaaattggactaccaaaaagaatgatgataatctgtctaaaaagagaaaaaaattgagggaaatagatgaaataagacaacagaacattggcaattattagagcagtctaatgtgtaattgtagtttaatgaatcattctcttcacttttatttgtatttgaaatgttctataataaaaagtatactatatgtatatactatattatatgttaatataatattataatatatataatattctatacatatataacactaaaacataagtaaaatgtggtagttgcaagaatataaagtttgaaaaaataaagtataaatgtaacaaattcaaatcagtgtcatataaagaagttaaataaaaaaccagaagctaaaagaaaaattaaaatgagtaatgtacctccaaccctaaaccaaactaattaccaaacatgttaaaaattaaatttaaataatataatcataaaacaattagaataaaaacaggcaattaatgactttttatcaaattgggaggttaaacattccaagcagaagactgtaaaaatggaaaaagaaaaaaaataaaggcttctaaaactctttcatatgagaagtaaaggactgtatgtctgaaaggataatgactgacttgcaaaaatattaagctaatattcaattatcctagctcaaaaaagcacctgcaaataaataacatgacaaatattaataataatctggtaaagcaatgaaaaaaagataattgcagattattcaccaaatagaaaagctactagttagtagatttaaaaataaatttaacttaccagaaataggatattcaaattaaagaagaaatgagattctatatgtgctcctatcaaattagaaaataatttattattataatactcaatattgttcagggtggactgagataactactctcataaatggaatatgaacattgaaaacccctttattggggcagtttggatataactaacaagttattttaaatgttcatgtatttaagctctcaaaatacatcttaagaaaattactgtctgtgaggttataatgaaaaataacttgtagcttaaaacacagaacatgattattgtcccaaaatatgcaaaatggttgtataaatgttaatctatctttaaatatgtttgcatacaagcctaaagtcatgtattataagcatttcaagatatacaaaatacatgatattggaattaatgagaaaagaacatattcataactaatataattataattttgtaaagaaatataaaggacaaaaattagaaggcaaaacacagcagtcttatgagtacctatctattggtggccatcttaagaataattttgattatgtatttataattatttttcaatgaaaaatgaagtttgcatgtaattattcaaagctacactattttgaacacaaccagaaataagaatatatcctatgattaactgaatgaaatgaatttgtatcagtatcaagtcaatacacagggaaatatcttgaaatgtaatgttaaatgatgttattaaagatgacatgttacatattctgaagtggaaattagccctgtgcaagcaccattcagtaaggctttctttgctacctattctggatattaaaatttcaagggtaccgtcagttaagatcactcagtttgggtttctttattagtaataggaaagattattttaataccctacaacaagagcagcattagctgctcaccagttgtttaatgagaattgaacccatgctatggaatcaagaatattaggatgaaaattatttaacatgacatgtagtgcactcatatcaaactacaaactacagtatattttgtctgttaattatcaatttttctgctgaaagaaactactaagacatttacccaggtgcaggaaacttttttttttcctggccttttctaatctttttacacaacatttttctgtactacttcctaatcttttacagcatcccacctcagcaaaagaccccgctgatcgatctaaaccactttgacattgaataggtcactttctgtgtcaggactgattggtactaattgcagagaagcatctgtcccagtctgctcttttttaaagttaagattttaaagaaacaagcacatcaattgaattgctctagttttagttggtttgtttttaattattggtgtatagatccctgcgtatgtaggaccctgaagataggaagttctttaataggcaaaacaatggctttcaaagcctcaaagtctcttttctccatctgaattgctgcatcgggaggaattttatcaatttttctgacatttaaagaaaaataaaaactcctgatcagagttctccagacagtgtctcttcaaatcctgcaatgccctttagactgcaattacttctttgtgattctttcaaatgtctcctaatagcagcaggtctggttgaaactgtccacttttggctcactgggtttttaatttttaactgcaaatgtggtataaaatcagaagaaaagtgaatgtgcattgattgcagttatctaaaaacgtttgtttaggccttttttgccatgtggtcagcaatacctgatatggcttcctccaacttccaactatgatatctataaaatgaaaataaataaaatgttagaaaataattatgaaactctagcacctttggggaaataaattatatggcctcatgggaatctttgctaacttcctatctagtaaaattagattaagagtaacctatttgggctttctgatatgaaattcccaggcttcctctcatgaaaggggattcctaaagcagaaaatcaaaacaggtaagacagtgattcttgcattcctcagaatatgtctcctgactctaaatggttgtgtaccttttggaaatagctgcctttcacttctgtattaaaatgctttctccctttctctcctgtctccttctttctctctctgtatctgtcttccttctttttggtcttaacagtgtagagtgacatgaggtgcagcacttctcaaaaaaatattcacccattaattctgctatttttctccatccaaatctaagtataaattaccaggaaagagtggtctaaaactgacgatggtagtgaaaggttgtatctaaaaaaaagttagattaataaagttagattaatagagcaatgtatataaacatggaaaacatagagaagaagaaactatagcagataattattccattcgcttaatacttattaattgagatttactgtgtgcaggcagtactccaggcacttggaatacatcaattaaaaaaaaagatctctacctccttggggcatatttggaagacaggcaataaataattcacctttacaaaaactaaattatatagtgcattagaaaaggcagtaatggaaatgaaaaagtaaataagcaaagagaatcagttgagctatcataatcgtagaggtcagagtagacaatatcgaaaaaatgaaatgtgtcacagttggggaatatagccataggaattaatggtagaagagtattattctagacagaaggaacaactacaacaaagactctatgttatgtgtgttcctactgtgtttcagtagcaacaagcaggcaaatgtagcagagcagagtgaatagggaaaaatgttagaaaaggatatcagaagagtaagatcggaccaaataaggatgtcttggaggctatttagggacattgattctttatttggtaaaaaaaaaaaaaaaggaaaaaaaaaaggcaaggcatttgtattagtcagtgttatccagagaaacagaaccaatagagtatatattgccacataagaggagatttattatgagaattggctcacacagttatggaggttggaagtcccataatcttcaagttgaagagcaaggaaagcttgtggtgcaaccaggctgagtccaaaaggcctgagaactggaggtggtgggtggctagtataagtcccagagtccaaatgctcccaaaccaggagctccaacatccaagggcagaaaaagatagatgtctatctcaagaaaagagaaagttttcttttcctccactttttttgttcttttgtgccctgaatggattggataatggccacctacattgatgagagcagatattctttattgagtctactggttcaaatgctaatctcttctggaaacaaacactctcacaggcatacatagaataatgtttcaccaggtgcctggatatcccttagaccacccaagctgacacataaaattaaccatcacagcattataaacttttgaatggaatactaacaatgtttgtcttacatttataatgatctctgtaaatgcactgttgagaatagactgttaaggctacagagggtcaggttagaggcaatgatagtaataagaaatggactaataatgacgtagagatattagctgcagtgaacatacaaatatcagataaaatagacctaaaaaaacagcagagagagagacagaagacaaaacaatttataatttaagcacacatgtgccaaatatagagagagcaaaaacaggcaccaaatatatggagagcaaacacttatagtaataaagggagaaataaataattaatcagtgataagtagagacttttgtattagtttcttaggattgccctaaaattacctcaaactctgatggtttaacttccttgcctactctagtttctggtgatttgggggaattcctggcatccaatctctatcttcacatggtctttcctcccttgtgtctgcctgtttgtcttcacgtggtcttcttatagatcactagtcactggatttaggtttcattctatttcagtaagacctcatcttcttaaattacaactgcaaggatgctatttataagttaggtaaaattagggggttatgggcattcatgaattttgaagggacactactcaactgaatagagtgtattctctgcccaccctctaccaaatttatacctatgtgtagaatgctttcatgcaatcctaacattctccaaagtcttaactcatggcatcattaattctaagtcccatattttatctagattcagactcaaaaacttccaaatctcatcatccaaattatctaaatcaaataggggcaagactttgggtacaatctatcctgagaaaaatttcttttcatctgtggataagccaaactaaaaaacaaattacatgattccaaaatataatggtgagacaggtgcagaatagacattcccattccacaatgcagaaactggaaggaaaaaaaggggttacagatcaagaaagtccaaaatcaaaaaggtaaaattccattagattttaatgccttcaaataacactcgttggttggaggtggcacactctggtcctacacaggccacatgagccccagtatctcagcccgtgaaggtctcattgccttgacctgtggatgtagtggtcctgctctcagtttcctgcatatagaatcctagaagtctgatagcttttcttaattttattctgtctaccctcttcaatctaagatggcagtgtttttgctgatacaatgttctcaaaactcttgtcagtcttctgtggaagtcaaggagatccatgacatgacaaaagaaggttttccacagatccttcttgaataacccatcgctattattggcttctgcctagataattcactggactcataaatcacacattcaatctactcagcaaaagtattttccaactatactcgtggccctgtttacaagcacacctttaggataggctgataattttctaaatcaactagtgctgcttcctttgtgcttagcagttccttcaccaatttatcttttttttttcttttttttacattttaccataagtggcaaggaaacccggatcacaccttttgcattttgcttagaaatcttctcgctaaatattcaagtttgtcacttacaacttctactttccatctaataacagaatataatccagcctggtgttttgcctttatagaaaggattgcctttccttcggtgttcagcaacacgttcctcacttccatctaagacctccacagaagcaccttaaatgttcatgttgtagcaacattctcttcatgttgatatatgaatcatcttagaagatagaacccttctctatgctctcctcacttctttctgagcccacaagagaatcgcctttaacatgtatgtttctaccaacaatctcttcaagaaaatcttgattttttttctcttgtgcatctcggaataatactagcctctatttatcatccaattccaaagcctattttaatgtgtagttatttgttaaaagagcaccccatttcccagcaccaaaatctatctcagttttctagcagtactgtaacaaattaccccaaagttggatgacttaaaaaacagacaattattttctcacatttctggaagatagaggtctgaagtcaaggtgttggcagagccctgcctcctttaaaggcatgagggaaggacccttctttgcttctcttatcttctggtggtagttagctatcattggccttatttggcccatggcagcatgactccagtctctgccactgtcttcaaataggccttttccttgtgtgtctatgtgtcttcacacaatcttcttataaaagtggacatggagagtgaccctacataaataaagctttatataagcatattacgaatagttgtacaccataaagttagataacttaaagtgaaaaaattcctatgaatatgtaaaccagtgaaatgaactcaggaagaaactgccaattcgaatagacaaaaaacaagtgaagagatggaaatagaattaaaaatactatccacgcacacacacaaaaaaaaaaaaaaagaaaaagaaaaaggaaaaaaaagccctcaggcccagatggcttcactgctgaattctaccaaacatttaaagaaaaattaataccaattcttcacaaaatcttccaaaatataaaggaaagaactcttctcaattcattctatgatgtcagtattactctatcaatagaataaaacaaactacatgattatctcactatacatataaaaaacatttgaaaaattcaacacatttatgtgataaaaacactcaacaaattaggatggaagagaaatttatcagtctgataaagcgcatctatggaaaacccacaactagcatcagacttaaaggtaaaatactgaatgcttttcgcctgaagattaggaacaagacaacgtgtccattcgcaccaattctatttaaaatttcactgtgagttctagcaaggaaaagtaagaaaataagataagaaaaaaaaaagaaaagaatatcaatgtaagattcgaaaatattgtatagtaaataattcaaccctgctcaaaaagtgctccagccgttgccctaggacactaggaggtaatcttcacattcttggaatgtcaagataggagcacttttgcttacctgaggtccttgagctagccacatagtaccaatgtgactctggatggggctttaggtgagtcatatgatattagcttaacctcctaaagggctagagctaagattggtcatggaggcagacaactgtgcccaaggtatactctgaatatcagagattgggtgagcttccctgtttggaaatattctgtatatattgttacttgttgataacaggacagtaatgctgtcctgactccactgtgatagaacaatttgaagctctacgtttcaggccttcctggactttgccctaattccttctcctcttggttgattttaatctgtatcatgtagttataatgaaccataaccatgattataacagctttcagtgcatcctgtgaggtcttgagcataatttttggaaccacccaaacttaaaattggtttcagaactaagggcaatcagtagacttttccttaactttgccattggctaaccttcacaactataaagctattggaagtaaatctttataaccttggattttggtaatggattcttagaaatgatgccaaaagtatgaacagcaacaaaaacaaattacacaaatttgacatcaacatgattaaaacaataaagaatgacctctgtgtttcaaaggatgctgtcaattaaaaaaaaaagacaacccataaaatggatgaaaacatttgtgaatcatatatctgataagggattttatatagaatatataaagcactgttaaaattcaaaagtaaaaagacaaaaattgcaaatgaaaatttagcaaacgacctgagtagacattttttcgaagacaatacacaaatatttgttaagcaagtaccattgtacagccgctttagaaaacagtctggcagttcctcaaatggctacagatatacttaccatatgactcagcaatctactctttgttatatacccaagagtaatacaataatcatacatatatcttcatgcaaaacttgtatatgaatgctcatagcagcattatttataatgtccaaaagttagaaacaacacaaatgtctatcaactgaataatggatgaacaaaatgagggatttatatacaatgaaatatcatttagccttataaaagaatgaagtaccagtatatgctctaacatgaatgaactttaaaaacattatgctaagggaaagaagccagtcacaaaagaccttactacatttttccatttatattaaatattccgaatggcaaatccatagagacagaaattagattagtggttgcttagggttgattgggaaattaggggggtaatatctgaaagatatgaggcttcttcttgaggtaatgaaaatgttctaaaattaaatatggtggaggttgcatacatctgtcagtatgataaaaactgttgagttccccactttacatgtgtgaattgcctggtatgtgagctatatctcaatgaaattatttaagatgtttaaaaatatataagtaggcttagaacttacacagaatggaacctacaacttcctgcccagtcaccagcttgacaaataggacacaagtcccaagagctgggagtgaaacacaaatatttgtaggcaggctcacagctagctgcataaatacaatacaaattccactgtaagaagacagagccagaacaactggtgatttacacacattcttatatccagtcagtgacagatcaggaagaagagccccaatacccaaaatccagctcagggtgctgccaaacaagcaagtgaatatagaagcctgcctttctaaatttgttgtctggctgccctcctcccagggaagggttttccatagaaaaatacacttttttaaatgaaacaacaatgtatataatcaatcaaaatattaattcatagtatatatagtatagaataaagaaaagactggaaggatatgcaccagattaacagtaaatacctctgatagagggaattggaaaggaggaatagagtcatttttcttttcattttcttataaatttgactttgctaaaacaagtgaatattactttgtcatttaaacatatatttaaatagttttaaaaaacatttaaagaggacaatgaagctgagttttgaaggcataatgacattttacagtaatactatttccatccaagttatttttcacatctaaagtagtcataaagaaattttcaggtatccaagccttccagaattatatacccacatcttgaaatgttttcctagaaaatataatccaagtaacctaaaataaaatttaagagtttacatttatgagtttaagaatagaacaacttttatgagaagacaatggtcagcattgataaccattcaatattaattgaaataatttctatactactagtctcacttgaatatttcatagataccacaagcttttcaagtaatttttatcttcacacacacacacacacacacacacaacaaaatacagtatattattctattaacctaagcctcacaatggctcaaccagtgatctaggagtcattgcttttatgacttgaaagttttacacattatgggagagagaaggcaaagtgtacaaggttttctttaacttttgatattaaatctatcaggaaacaggacagagcacaaaagataggctggcctgtgttatatccaatactaactcagatgaactaaaatactcaaatgtctcttaacctctacgttactctggcttcccagggagatgacagtattttagaggcacctgctagcatcaacattaaagtcatgtaattatgtttttcttttctttttttaaatttatacatatatatatttattatattttaagttctagggtacatgtgcacaacgtgcagatttgttacatatgtatacatgtgccatgttggtgagctgcacccattaactagtcatttacattaggtatatctcctaatgctatcccacccccctcccccaaccccacaacagaccctggtgtgcgatgttccccttcctgtgtccaggtgttctcattgttcaattcccacctatgagtgagaacatgcggtgtttggttttttatccttgtgatagtttgctgagaatgatggtttctagcttcatccatgtccctataaaggacatgaactcattattttttatgactgtatagtattcgatggtgtatatgtgccacattttcttaatccagtctatcattcttggacatttgggttggttccaagtctttgctattgtgaataatgccgcaataaacatacgtgtgcatgtgcctttatagcagcatgatttataatcctctgggtatatacccagtaatgggatggctgggtcaaatgttatttctagttctagatccctgaggaatcaccacactgtcttccacaatggttgaactagtttacagtcccaccaacagtgtaaaagtgttcctatttctccacatcctctccagcacctgttgtttcctttttaatgattgccattctaaatggtgtgagatggtatctcactgtggttttaatttgcatttctctgatggccagtgatgataagcattttttcacgtgtcttttggctgcataaatgtcttcttttgagaagtgtctgttcatatccttcgcccacttgttgatggggttgtttgtttttttcttgtaaatttgtttgaatttgttttagattatggatattagccctttgtcggatgagtagattgcaacacttttctcccattctgtaggttgcctgttcactctgatggcagtttcttttgctgtgcagaagctctttggtttagttagatcccattttggcttttgttgccattgcttttggtgttttagacatgaagtccttgcccatgcctatgtcctgaatggtaatgcctaggttttcttctagggtttttatggtttttggtataacatttaagtctttaatccatcttgaattaatttttgtataatgtgtaaggaagttcagctttctacatatggctagccagttttcccagcaccatttgttaaatggggaatcctttccccatttcttgtttttgtcaggtttgtcaaagatcagatagttgtagatgtgtggtattatttctgagggatctgttctgttccattggtctatatctctgttttggtaacattaccatgctgttttggttactgtagccctgtagtagagtttgaagtcaggtagcatgatgcctccagctttgttcttttggcttaggatggacttgacaatgcaggctctttttttggttccatatgaactttaaagtagttttttccaattctgtgaagaaagtcattggtagcttgatggggatggcattgaaactgtaaattaccttgggcagtatggccattttcatgatattgattcttcctatccatgagcatggaatgttcttccatttgtttgtatcctcttttatttcgttgagcagtggtttgtaattctccttgaagaggtccttcacatcctttgtaagttggattcctaggtattctattctctttggagcaactgtgaatgggagttcactcatgatttggctctctgtttgtctgttattggtgtataagaatgcttgtgatttctgcacattggttttgtatcctgagactttgctgaagttgcttatcagcttaaggagattttgggctgagacaatggggttttctagatatacaatcatgtcgtctgcaaacagggacaatttgacttcctctttcctaattgaataccctttatttccttctcctgcctgattgccctggccagaacttccaacactatgttgaataggagtggtaagagagggcgtccctgtcttgtgccagttttcaaagggaatgcttccagtttttgcccattcagtatgatattggctgtgggtttgtcatagatagctcttattattttgagatacgtcccatcaatacctaatttattgagagtttttagcatgaagggttgttgaattttgtcaaaggccttttctgcatctattgagataatcacgtggtttttgtctttggttctgtttatatgctggattacatttattgatttgcatatgttgaacgagccttgcatcccagggatgaagcccacttgattatggtggataagctttttgatgtgctgctagattcggtttgccagtattttattgggaatttttgtatcgatattcagcagggatattggtctaaaattctcttttttggttgtgtctctgccaggctttggtatcaggatgatgctggcctcataaaatgagttagggaggattccctctttttctattgattggaatagtttcagaaggaatggtaccagctcctccttctacctctggtagaattgggctgtgaatccatctggtcctggactttttttggttggtaagctattaattattgcctcaatttcagagcctgtaattggtctattcagagacttaacttcttcctggtttagtcttgggagggtgtatgtgttgaggaatttatccatttactcttgattttctagtttatttgaatagaggtgtttataatattctctgatggtagtttgtatttctgtgggatcagtggtgatatctcctttatcattttttattgcgtctatttgattcttctctcttttcttccttattagtcttgctagtggtctatcaattttgttgatcttttcaaaaaaccagctcctggattccttgatgttttaaagggtttttttgtgtctctttctgcttcagttctggcctaatcttagttatttcttgccttctactagcttttgaatgtgtttgctattgccttctctagttcttttaattgtgattctagggtgtcaactttagatctttcctgctttctcttgtgggcatttagtgctatcaatttccctctacacactgctttgaatgggtcccagagattctggtatgttgtgtctttgttctcgttggtttcaaaaaacacctttatttctgccttcatttcgttatgtacccagtagtcattcaggagcaggttgttcagtttccatgtagttgagtggttttgagggagtttcttaatcctgagttctagtttgattgcactatggtctgagagacagtttgttataatttctgttcttgtacatttgctgaggagtgctttacttccaactatgtggtcaattttggaataagtgtggtgtagtgctgagaagaatgtatattttgttgatttggggtggagagttctgtagatgtctattaggtccgcttgctgcagagctgagttcaattcctggatatccttgttaactttctgtctcattgatctgtccagtgttgacagtggggtgtaaagtttcccattattattgtgtgggagtctaagtctctttgtaagtctctaaggacttgctttatgaatctgggtgctcctgtattgggtgcatgtagatttagggtagttagctcttcttgttgaattgatccctttaccattatgtaatggccttctttgtctcttttgatctttgttcgtttaaaatccgttttatcagtgactaggattgtaacccctgcctttttttttgttttccatttgcttggtagatcttcctccatccctttattttgagcctatgtttgtctctgcacgtgacatgggtttcctgaatacagcacgctgatgggtcttgactctttatccaatttgccagtctgtgtcttttaattggagcatttagcccattcacatttaaggttaatattgttatgtgtgaatttgatcctgtcattatgatgttagctggttattttgcttgttagttgatgcagtttcttcctagcatcgatggtctttacaatttggcatgtttttgcagtggctggtaccggttgttcctttccatgttcagtgcttccttcaggagctcttgtagggcaggcctggtgttgagaaaatctctcagcatttgcttgtctgtaaaggattttttttctccttcacttatgaagcttagtttggctggttatgaaattctggtttgaaaattcttttctttaagaatgttgaatattggccacgactctcttctggcttgtacagtttctgcagagagatctgctgttagtctggtgggcttccctttgtgggtaacccgactttctctctggctgcccttaacattttttccttcatttcaactttggtgaaactgacaattatgtgtcttggagttgctcttctcgaggaatatctttgtggcgttctctgtagttcctgaatttgaatgttagcctgccttgctagttatgtttttcacttccattttaataattatcttgaaattacattttatgctagtgtatattcatatgtatatatggttacataaacatacacacttatatgtacacacatgaactgtggatgtatacaatttggggtatagttttgaaaattacattgaaataataaaaatgctgacattaaaataaaagatgagaaaaatagattaatagagaaaacttgcaaatataaaatatagatatatatttttcacatataaactatatggcaacattacaattgatattcataaattaaatttttttaattaaatgtgttatttgggaaacatatttttttcttttaaagaacaatttaagcactattctggaaatataaattatactaccattaatttaaactctggtataagttgaaatcctcgtgcacttatctaagactatagataactaatgtattgaaaattcattatataagatattattacctatgattttaccttatacacaggatagtaaatctcaaaattgtatagtaaaatttaatgatacaaatagttataaatttgcatatatttaatggatttactatgcataataggaataaattaattttcagcagtaatgttaatctatatctaacatcaacttacaagtaaactggatatattcctcaagtctttaaagcatcaatttaaaattttccaaaatacatattacgttttagtttctcagattgagacagtacagaatatttcctaggataattttatgcaatgaatctaatgattgttatctagaagaagttacttgaaatgtccatattaatattgatagatattttcatcagcagatatcgtataaaatgagttttgtagaaaatagccaagaatgatcaatgttatattcttacacatgtgtaaaatgtgaaatagtaaaactctctattttaaacacttgttcacagaacatatataaaataacatgtgtttctcagataaagtcctacaccgttaaaatactcttcctgaataaagattacttaactatatcttcgagtagggcaaatgtgtccttttacagatctggtttctttcaatcagtcctagaattaaaatgcattaaattctcttcctaagaatctatatattagtttcccactattactttagtgttctcctactgaaaattggaatacataagacaatgtcctcaaattatcagaaatgtactaattcctctatgcatcctccactgaagacagagttacatgctaaacacctagtaatgtgggttcctagggcccttctagtcactaatgtgaaacagtaactgtatttattttcaaatacttctttatacactttatccattattaaattggtatagatgtacataattatagaactgtagtttagaggagactttataaattattctaattcactttctgtactgggaattgtttcagttgcagatgaagaatgtaaaaacagcatttcatttataaatgcctctgttggaaaattctttgttaaagcagactaaactataacttcctagtattttataaccatatattctagttctgctttctgttacacataataaacatattctttttggcaaagcacagctcttagatatttaaaaagaacgatcacaaatgcctgtcttctcttgccgtgttaaataatgtgggcttcttctggaactccttatgctactactttattttctagctttgttggcttttggtgaccctttcctagccccacttcaccctgtcaacttcctttccatcataggtaaagaatacagagttcaatttaattatttcctttatttgaaaatggaactgtatcttgaatgacaatcaggcagtacccttcaattacaactgatttgtaatcaattaaaaatttcatgtaaaaacattaattttaacacctaattttcttttcaacatatatgtaagcatttaggatttcacaaataaattcacaattctaaatttttaaaaataagttgtaagcatcactacactaaaaggtgtggaagtaaaatttataagtaaaccttaagataccatattcaatttggcattataatgactttaattttagtgaacaatagagaagaaaagagtggatataagtttatatttttagtttgaattagaggagtttgtcattagtttgtttatgaagcgaagtgcagggaacaggtttgtggaagagtggagtttaattctgaacacactgagcttgagttccctgcaaggtttccaggcaaagaggtgaaacatatagttgaagaaaagatcaggcagaaaatggagaaaagatcggacagggctcaaaagtagacagaagagaatggagggatttctgctttgagagaaatcatactcatcaatgcatatgatttgtaagttatctgcacaagattttgtgaactgattaattttgtcctgttaaaataagcaaactatactactttctgttcttccaggtatgttcaaaattatccagtgtaaattttaaacatatctacattatctgcatagatgtgctatttgaagatataagtaggaatgagctttctaagaaagagtgtaaaaaagagaagactgtgaagatgaactcagaaaaacttttattgtgtatttaataaaaagagaaggatccataggagaggctgaagagtatccgaggaattacctggatgctcagaaagcttatttctattcttcccaaacactccaccagcagacattttccagcttcctggtagttatatttagtcgtgttactgatttccggataattgagagttttatggaaatgaaaaaagtcagtatctgacttccacacattatcttcactgtttcatttttctagtttctggtaaaggtgctaaagaaaaatgaaaggacctgcgatcactggataacatcctagaagggagtttcccagtggagctgtctaacctggagcatccacaaaatgagaactgtatttttatgttgccttattattttattacatcagtgcatacagagaaaattattttctgttagactaccatccagattatttgctttaatttcactagctacatgttttttagactttgtgtgacatttttccacttctttgtgtgtccaaggattttttatttaatactagacattaagaatattgcactgtagagattctggttggagacacactgaaaggagttgaagagctataaataatttttaaaagtagataaaggaagcctaaattcttcagagacctttggaacctaaaggaagaagagatattgaaagtaacctatggataatataattttttaaatctagctaacttatttgctttaaacaaggctcggccacaggaaataaaatagggaaattagagaatgaacatggaagaaaaggaagaataactacatatttctggaaaaagcagaaaatgtttacaataagagtacaagtaattaatatgcattttggtaatgcatcttcaaaggtaaaatgctgtgatctgctgctaattgacacattaagaatcatcatgttttgagtatgattgatgaaaggcataaatattcctagctagaacatatatatgtcagaatttttcagtattagctataatggtattataaggcatttaaaaaatttggctaaagttgacctacactattatagtaatcatagtaattgaacgttaagtcagcctgtcatgacttgtttagtgaacacatatttatttctattaatctttctgaatttaattttctggcccttcaaaattaatcaagcatattcgttttaagaaattgtgccattgggatcggaatatctatccacttatctgcttgtgtatgtgtgtgtgtatgtgtatttgaatttcctgaaacctgcacatttaaaatctgtcaaatatctgtctagagtcaacaccccttttatttgatgctactaaatctaacatggtattagaaaataggcagaaaaataagagagaaaaaattcccagtcaggtgtcatatagaattttgaaatttgtgagataggatgataacagtgtgttgtgtgtagagtactcttgggttgagtaattgagggaattagcagacaccatggaaaagaggagataaccaaatacacatttcacctatttaatgaagtgttgcaatgtcaattctggttgttgttatgaggactgtcattattcaaatttctaccagtgttttccaagcctcaagatagatgatgatatatgtgaaatcattataatatcctgtgttaaagaaaggtatttcagggtgccacaaacatagctttaaaatatacgactttctttctttctctttcagttggatttatattttcacctattttcctacacttctgtgtaggaaaacccaaaggaaatacacttattttttaaatcagtggtttttcagctctgattcaacattttttacaagaccaagcctattttttttgaaatgcacaaagaattataaagcattacaacactttgctgctagcatgcaaatgattgaaagttatatcttttaatatgtagtccagaagactgttttcctagatgtcctagaaacttgaccaatcagagaagatcctaaacagcattttatatcaattatgtgcaaaaccctgccaattatcttctcatataatccccatcaataaccgagaagcataaaagatataaactcaaaccatctgctctcactacagtaggcaactgagagcttagacaataactcacacagtaaaatactccaatacatttatctgggatcatgctgtttaagtgggatttgtgattaaaaatattaccactttggcctatccactattagaaaatatgttttccctttttaggaaaagcactgtcatttctgttttattacaatagtaaattaagagaactaccgccagccatctataaagaacaaaaactgcacttccagtttatgcttcactgtaattctttttcctgttgatgttaacaatacccaggctcttaaaaaaaagaaaaggaaaaaaaatagcctccagaaattcattgctttgacacctgtgtaatttttgaaccatgctaaatgccaaaataaagctgtatcaaaatataaaatgttaaccaaaagtgcctatatgacctaagaaaaggaagtatttaaagataacagtcacctaagatggctgatatttaaagataatatagtgtgactttttctaagcgtttgaggcacagaactgacagttggcaaaaatagataggattccaaacgctgttgcaataagagtccagaagacagacaattccctcctgttctccatcagtgtccttatcttacattataccatattcgacctgtcaagatatttcaatatttcccacattaacaacaaagatatgtaaacgacgatattacactgtcaaatcccctaaacatccctgtgtttcatttacaaattctcgagtcagtttgccgatgaattaacatttacaattatagttcctatgcatcttacagaaactatattttacttgttcccagacttcaataatataattttgcaatcatggtttgaaaattatactgcttgacatattttgccaattgatgaagcattactttagagtggattttcttcactctgttaccaattaaatttacattttaattagaattaaaaattatacccttgatgatagattgggggatgaagaaatatagtagcttaaatattcagaaaagctatgtattgtgccatttcacaataagatattcacaagtgtttgaaaagcaaggcaagattcttatggtttgtgcatgagcactgtctcatttggctaccagtatgtacatataattatgatatcatacagtttagtattctcttttacacatgaggaaactgacaaaaaataagtgaggaggtgagcttggatcagatgcacacatttaaaagagaaatgtaattacaaaaatctttttagttataaggtactacgaacgatgtaaaaaattctgtcaagcaatatttcaattccctcaaattgagatttttaaaaattgaggttggaaataaatgaagaaattatgttttctgactattgtttctaaagcagtctctttttttgctgaagtcagaaatacatttcatttttaaatttttaaatttaaatttttatttttccataggttattggggtactggtggtatttggttacacgagtaagttctttagtggtgattgtgagattttggtgcactcatcacccgagcagtatacactgcaccccatttgtagtcttttatcccttgcctccctcccgcacttccccccaagtcccgaaagtccattgtataatttttctgtctttgcatcctcatagcttagatcccacatatcagtgagaatatacgatgtttggttttccattccttagttacttcacttagaataatagtctctaatctcatccaggacggattactacatttcctatgacatttgaaaaaaaaaagtgatcatgcaaaaataccttccacagcaatggatgataataattaacaaaattataaaaactgtttcagatgtttgaaatgtattaagctactagcaacaagaaggtttaaagatatccctcaagattcccaccctctggtgtatatgctctgtataatcaactctccttgactgtgggtatgaactgtaagtatgacgcggtagccgctcccactgcataactaagttctattatacagcgcaggagactttaagaaatggagattaccctggtgtgttgatctgatcaagttaggcctttgaaataagaagcacgttgattcttgctggtgaaagagatacaaaccctgagaagacttgaagccccagagagtttccaaggctggtttgaagatgtgggaggccatgtgaggccattgagagtgacctgcagccagtggccggagaggaactgtattctttcaccaatctgaatccgctcggaagaggaccttgtgctgccactgggaatgcagcaggtcaacacccgatttcaaccttgtgagtacatgagcagaaaacacatcaactttccaaatttccgacctccaaaactatgagccaataagcagctgttgttttaaactgctaaatttgtggtaatttgttttatatacagcaatagtaaactaataaaccgcttaaaactgtgtaaaacccaaattacagtctacagtggaatatgttgttatgattccatcttaaagaatcctaaattagttttgaacaatccaaagtgacattgatatagatttcttaaaataaaataccagtgtccagaaattttctccattcaacaaatatttgttgagcagcttcaacaacggtttctcgatgtgtgggttctagcagcgaagagtacagacatagtctcacctctcattgcctctcctgagaggcccagagacatattctttcttctggaaactgagggagaagtatgcttgtcattatcatatttattaaagtatgagcattattggaacatgtcttcattagaatgattcgtttccctacacaaaaatagggaagcaaattattattatttattatttattccctaaactatttttatggccaaaacagacaagccaagctaagcaattgccaaaattcttaataaataatttaattatttattaagaattaataattcttaattaataattaataaataaataaaataaaacaaattttctttttaacagaagtatgagtttaccaattctgtttaactaagcagttgtctaccaaaaaataataataatgccccgtatcaattttgatgatgctaggagtaaagaagaaattagatgctgataacagagttttactatacacgagtctacaaaaagaggtaaaatgaactttggtttgataaggaaatttggaatacagaaaaaataagaaataaaagaatacattgtctataatgaaaaaccatttattgcttaaagcacacccatccaaaatatctgattctcaatttttattggctttgagctattttaacagttctgtaaattgtaactaagagcaatgcacataattattgtttatagataggcaaacatattctttctagtgaaggttcaattgacgtcctcctattcagtttacaaaactagttccacgctcatttataatttatttaatgttcttttacttcatataaatttgtggttctttgagttctcaattgagttggacaacaatcttccagtttcctcattaataatgagttaattcaaatctttaatacatgttcattttatattcaaatgagaatcattattttatattttttcttttgaaaataatcatttagttctgtgaggagacagccaaaattatgagacttccaaaaacattaattttgtattttaatgatattcacagtaagtcataatttcttctcagttaatcctcttagatttacatggttttgccaagattgaggaacttcttcaatgtacctaatttctaattctgtaattcagaattttcaatttagaaataagaataccattcgtaagatgaagaattccaccaaatagacacccaatattaatccatctcctctgcccttctttttgagctttatttttgaacattatttactatctgtagtaggctgaattagtagttccccaaaaatacccacatcctaattcccagaatatgtgaatacattacccaatataatccccgggtcccgtgaatacgctattttgctttgccagtatatgaaggattatgagaagggaatattattctagattatctgggtaaattctgtgtaatcacaagtatccttctgagagggaggcaagagagtgagagtcaaaaaaggcaacttgatgatggaagcagatggagagaaggagactggaagatgggaacaggtcacagaaaaagacagtcagatatgatgatgccacaactgctagcctttaggatggagaaagggacccgcagccaaggaatgcaggaaacctctagaagctggaaaaggaagggaagaagatagtcctatggaactttcagaaggaactcagccttgccaacctattagagatttctgacaatttttaaaattgtaatacgttttcattgttttaaaccactaaatgtgtggtaacttattacagcagcatcaataaactaatactccatctaaaatgactgtgagcatagttgccatagaagcctcttttacactaatgttttcatggtggcatcaaaacttaatatctaagaagttcaatggtatagataattatagttaaagatctttatcaagttttgaacattttaaaggttatcgttttacacatcgatccatttatacagcagtgtgtcaaatattacaacagtacttaattatctttatagaaaatactttcacacagcaggatttactaagtacacatggggtacatggcttttcagtaacttacgacatgctgacactgcaccaatgcttcacagacactgggatatttatggttctaaatttttttgaagaagaaagagccagtttggtttttgctaatttatttaactttcaatcagtagtttatacaatttaatttccaaataaaatatcatctaaagactgattgtttcttttgtatttctgtcctcactcagaatcatgagtaatgttcaaagacagcaacggtatttaataaatgctcatttgtgtgtgtatgtacatacacacaagtgtgtgtgtgtgtgtgtgtgtgtgtatatatattatatatataatatatatatataatatatatataatatatatatatgcacacatttttagaaacagggtctcactctatcaccctgactggaatgcagtgtctctatcatagctcacagcagccttgaatcagggtctcagtaggtcaccctggctggagtgcagtgtctctattatagctcactgcagccttgaattcatgggctgaagtggtcctcttgtcacagacttcaaaagtgttgacattacaggtgggagccaccacacctggcagctcttgcataattgagtatttccaaaaaatgcaactgagacatatgaaaagagcatcctattttttggccttctccaatcatatggcatgcattatatttttaagtgaatacatataaccttttatgccctgatcattcattgtagagaaggaaaacaaggaacacaaaacagtaggcatatttatgttggctataactgaagttggccagaaaataaaatagccaagagtttcaatcctaatcccataaaaaatgtgacttttattatctccaatatcatgcacctcattgagcactcaaaacatcttcagaacctaaaaatcaaagcatttctaagtcaaagctttccaaaaataaacatttctctacaaatttaatttagcttacatatgcagatttatgtgagtgagactataaatatattacctgtatgttagaaatgatatcataaattaattctgatatcatgagatttggaaaaatcacctaagtattgaaatattaattgtatagtatatatgtatatgtttatatacctacttgcatgtaaggttgtgtatcaaaaggttttgtgtaacaaacacttttataaatcaaaagctagctgcatctatgtcaatgtgttcctgcagttgaataaccagattggtctgtgtgacatagaatctggttctcagctggaaacttaggtctcctaaaatgaggagtccctctagtattaggtatgtggaacaattcttaaataatggcactgtgaggattccacctcattattatttaaataagttcataaatgttttacttagaatgcaagaatggaagctttacatcttgatacactagtggtatggcttcccatctaatttgttgttgttttaacagatgtagagttaccatactatcataaaatatggtaatagtagaacaatatcctagaaaaatgctgaggctcatattataatgtataaaaccaatcatctcaacacattcccaatcctttgtactcagttttacagtagtgaatccatgaacagataggaaggggaaaaagaattgggtgactataactgtagattggaaacttctaatagtaaaatgttattaatttaagacatgcataaacaaaacttggtaaactaaggctctcctaggaatgttaacttatcctcatttaatatatataacatgtggtattttaaattaccagttaggtttctaaatacgtattttattgtgcaggcagtataatgctgatgatataatgttaccatgagaactgtaacttttctgttctgacatatatgctcagatttgtaaccttgttgttacattagccttgaattgcatttcagatatatttcttgtggttctgaaagagaaagtgaagaaaaaaatcattttaaaaaacacactgagttgtggaaatacacatactaaacaacaatgctgaatttaacaaatctataatcaatagcacttcaaaagatgacaaccatattgaaaattaaataatatgtcatattgagataaaatttcactttctgccttttaatttattaccatagaaataaatatcttgaaatttatatcctttcttcctatttatattttaattcgttaactttcaacgtcccttgacatatgcacaaactagtatttatcatctgtggtacttttgaattaatgtatttaagtgttagattctattaatgcattttaacactaactgtttttgcctcaacaaatattatttaaacaaaatataatgcagaaacattgattaaaacatttcttagataattcttttaatttacaaacattttaaatatacagcagaaaaaataggaggtaggatttaccatacgctctgatttcacttaaaagacagttaggattgggtaatttttaatgttaagtacattgatgacatttatttcttttgagagttgataatgaaaacaaatttggattattgatcctttgtgaagctgaaaagtctcaagtgtgcactgctgtataaaataatattttataaacatttgcaaaccaagacaagttgaaaatcatttacatatttaaaaataataatacttcatctcaaaggcttctaaggaaagtcatctgtcctctggttgtgtttcatctcaaaacaaacaaatataaaatcaatagatactgaacaagagaattaaagctcagagcaattttatttaccaaattacaaaatagtcactgagtttaaatgtaacactgcatggggaagaatggaagaggcaaaaaagttatcatactcaactcccaaatactcgatttgtgcttagaaaaacaatacaggttgtcattatcattaaaattattgatacctttttgtgagtactgcactatataccaagttaaaataactgagagaagagcctgtgtaactctgttgttttgctagggtaacctgctgtataactgaaatgaccatgagaaatagatgccaagtcactcggagagtgcctctatgagcatttcttgaaaattcaacatggaagctattacctctcaagagatgaatagacaggcttcttggggatgagtatgtttcacatgtgagctctcaactgggggagggaatattatggtgaaattttttaggtagaacactagaatgtggtatattgactaaaactaggatggttagttcttaactcaggaaaccatgtaaagttaaaattggatgagcttatgcagaagaaaataaaatgaaatatttgttgtcattataatactaatgtggctactggtaaatttatttttttcgttcctcttgttttcaaaaactcagtgtgggggattaacatgtcaatagatctattgcaatataatgtgacagggacttaatatgaaacgatgccatcaggattgggttctttcaactacaaatctgttctacatagtacaaagacaattgacataagtcactgagttgagtttttttgtgtgcgtgtgtgtctgtgtgtgtgtgtgtgtgcagttgtgtgtctccatgtatatttgcagtacagtaaaaaataaaataaaataaagcaaaataaaataacaatgtagaataaaaacttgtgttttgggctcctgattgaaaagaaggcagctattgataaaaaaattttttcatactgcaggaatataatgggcattatttattgagaatgttattgcttttaatgtatattttatttaaaataatgtgttctgtgattttaaaaagcaggtgctataggaattataaacagtataactatttctccaggtatttactttttggaatattttacaaatactcaacgaatgcttaagttacgtgttaaaagaaaaacattaaacctggattatttcatatgcacataatttctactaatttcccattttttacattctgtgtcttatttatccacagttttactttctttcattttatctccccattaaaggcatcaataatattgcaccatcccttaactctcactgtaacaccgtaccaatgtaccactaaatcaagctcactgcttctacatggaaaggggcagtatagcataagcattacgagatgtgtggagctagactttctctgtgactggacattctttctagataatttaaattatattttaaccagtgctattagataatattaaataagctgatagaaacaacttacctggaacaaattcagcaatacaaaaaaattaaataaattttgttatgattattcctgttatttcatttcaacttctagtacatatcattatagcctattactatagttttgaaataatggaagaggattactgaggaagtctaggaggttggcagaattcacttagaaattaaactcttttgtcttgattagattaaatacctgaagtaaatatttggttgtgaaatgtatcgtgccatagaacatgggctagcagaggagtacaggaaaagacaattaacttgttctcaatatgaaagtagatacagttgatattatctacaggaattaaagagtatataaaagagtaggagacactatgatgataaataaggagagttacctaaagaatatgacgacagcatagaaactatgaacaatgtttcctggataataacatctatacaactacattcactattgtaggatataggaaagatttgaaatggaataaatgttctccatataaataacctcactaaactggttgtatttatgtacaatattattataaatgtaactccaagagttattatttaataatttctggtacctgtacaacattatcctatccaaatagtttgggctatgtctttatttttcatctaaagcaagcacattttacttcaaggaaatttgaatttataaggcaaacagcaatctgtctttaagctttgccaaatccttggcctcataattattataattcagaaaaaatagaattgcatgtatatggagtctacatttacaggaaacttgtgcagtaagtgaaattcacttagattaaaaaaaaaagaaaaactttaaaaatcacttgaatcacccattaagtttaccctgtgtaacattgcatatgtaaccctataaagaaatatgtataaatgtatacttcagaataagcaatgaggtcataaaaataaatgctacataccacatttattagtcccttacttagcctgacaagattaaattgtgtttaatttttcagagtacgtaatttgcattagcaaaatttattaaagagaatatgatgcaatttcaaagaataatgtttaatttcaatattagcttctatgcttataatatctttagcttacatgagtattgttgataaatagtaattaaggaaatcattattacaaaatatcaagtttaagagcaaaataaactacatattgttccaaaataattatgtatgtgtaatatactaagccataattaaaacagtaatgtatggttttaagtataactaaaatataaatgtagaatagaatcaaaatcttaatacatacagtagagtggaaatgacaactggatcattcattcatttatttaattatatatataattgaataaataatacatagcctactgtttgccaaaccctggagatggaatgggaaatgatagaaaaatctctgtcttcagagagcttgcatcaaagtaaccagaagcagcactgaaaagacaaataattgtatgacatattttctactaataaagaatattgtaaataaagtttcaagggataattgtactcaatagtgacagtgactttgactttgataatgactaccttactttaaataaggtagttagagaggaaagacttcgtaaatctataaagattttgagatggttagagaaaattgttttggccaagacaggactcaaatgaatcaaatgtttattaagatggtctcactagggcagctcgccaaggctcatactggtagtcctcactatttgggaagctgagatgggaaaatcacttaagcccaagaggcagaggttgtggtgagtggtgatggtgctactctacctccagccgcctgggtgacagagtgagactctgtcccaaaaacaaacaaacaaacaaataaataaaacccagagatggtctcactagaaaaagtaaataaactggaacaatatgcagagtagcctatttaaaatggaaatgttggggatggtgaaataatgaatggtgtcaaaatctaggatctgattctatatgttaagagataagagggtgatgaggtcaaagattactaaggggaaaatttcaaatttcaaatcataagcaagagtttcaggcgaatcgcttgcatccatctgtcattaagcatgaatgctagtagcaatgcagggaaaactatttggcttgtttctgaaaacttacaatacagtagaattagcctgaagatactttaagtgatcacaacagaaggtgtttgaaggaaaagtgataaaatttggaagcagcagccacagtgggggagtaagataatacctagcccaccagcaaacctgtgctttagggtaccttggaaggaaaaagcaaaccaaaccaaatgattcaaaaaacatttcttgcaaggggcaacaaaatcagtcacgaaagctgtggaaaacaaggttcagttaaatgagaaacgtaagggactcttccaagctaaacacgacggtgatttgctgatatcagagcgtgacttcagaaagcagaagtttgggaagttggaaagggtgaaatgttggatgggttgagatcctatgggttaagatcctggcgaggatacataagcttggagcttaaatatttgtcggaacagaggaaaacaaggctgagaccttgctgtattcatttgcaaggttacctagaggaatgtggaaattcagttcaaattataaccttctttcctaggaaaggtatggggacctagattctagtactttctctcccagtaattaactgtagaagatacacgaaatttttctaagcatcactgtttttttgtaaaatcagaaggtgtgtggggtgtgtgtgtgggtgggtgggtgtgtgtagtggtgagggaaggggagacagagagagagaatgagtcatccacctttttttttttttttttgagactgagtctcgttctgtcgctgaggctggagtacagtggtacgatctcagctcactgcaacctccgactcctgggttcaagtgattctcctgcctcagcctcctgagtagctgggattatgggcacatgccaccacaccctgctaatttttgtatttttagtagagacgaggtttcaccatgtttgtcaggctggtctcgtactcctgactttgtgatctgcccacctcagcctcccaaagtgctgggattacaggcctgagccactgcgcccagccccatccatcttttaaatgtaaattaacattacaaatagggatgaacatatttgattaccacatgttaactcccatggtgttctttattttcttcctataaaatgcacttaaatggtacaagaacacatttttcttttcaccataaaattttaaaaaatatcaagtgcctcctttggaaataagtatggcatataattatcaatgaaagccaaaatcgtataattttataattttcacttattttattctacatgtatttattggatatttaatctgtaaatttacaaattgtttctaagtaagatttttaacatacagtattatcctaacttatagaaagctgtaggaggtagttttcataaatgcttaatcagacataatttgttatgtattagattgctatatgatataatctgtgctaagtattacttttactagacttaaaaacatagatttttttctgggtatacagaaatgtgagttgttttatttaagtttcctcatggcagtaagatttatatctattccctgaagctaacatgaataagatctatagatttctgtttacttttaacttcatatattctagaaaaattttgacatttaaaatatttgtgtggatgtattttatcagtttcacattaacataaatacataaacaagaagctttgccaccataattaaagctctctttagtcctaatgtctaaacgtattgaaaattatatgctttccaacatctcaaaataatcctaggaataaaatgttttaaaaaggtctgggacgtcagcagagtaaccacgaaagacagcaatgtcagggtagacactcagtggcctattatggtgggtacaggtacttattgtatattgtactacaatatttttcatgaataaatacttctaagcctacatagaagagccattactgaaagatttttataaaggttcttaacggagaatttaatgtcaaattcaagtgtgggccaccaataaaaatgctgaaaacactagctacattcttttttccattatgactaactttttaaacatctcctgtttttaaagcagcactcaaattactgataacattacaagaggctgagggaaagaaattcaagtttagctctcatttaacttgaggtagaatagtggctgcactaccgtaactgatgaagtgcaattcaggttctctttgaatacaaaagagaaggctggtcacccagtgatttatttcatttcacaaattattatatagtacttctgttttaagacataaagcatcccttttcaaagtactttatggattgatgggtatgaggtaaacatttccaagtaatacttagtgttgagccaaaaatatttttctacttctaaattactgccatgcagacagagaaaagtaactaaatgcagaggaaagtcagtcttgctggtagctaagagggctttttgttgttctgtaaaactttctatagaacttgaaagaaaaggaaagaataattctaaaagctttcttgcttgtattataggagaaaaggaaaactgcattgtcagctctcaactttgttatgaaaatgtaccatgtaaatgatataaattagcactgactacattaagaaaaatattttaaaaatattgacccatgaagctgtatttccccatgtaatatcttgcatatatttacataacgtaatacataattttctatgtaaaaatgcctttaaatattcaacgtgtaattaccagtttttccatgggttgcttttaagctgttttattcctaattattctgacatttatttacttgttcttattcctttgctgctccatagtcatctttttgctcaccacattgtgacaatatcaagaaaaaaatgtatgtgtagatttctttatctcttattttcctctgatttgaaaattcatcaatggttgctgcagaagctgcctgaggcctttgggaacataaaaaagtttcaaagttgcttgtggaatgatctagatgagaggaagtgataacacttaaattgatttcctattccataaaatgagtattctgttagaaagatattccacataagactgaatgaattttgtcctctaatagtttgacaaagacagattcaacatatcaactagttatatgccaaagtcagaaatccctcctcttctcacctgttctcattattttcaacatatgccttccacctctgtgacctattgatgcctggaagtgtaaccaaaagtgattggttaatgatgagaaacaatttccattaaatgggtatcactaatttgttaacacttcagaaatgtaacttggcctattgaggccaaaaacgtattttattcagctttctggatatgatctgtaacaagaaagaagttagaatcacaaattatctcacaaaaaagtgatgtttgtccatgaaaatggttgagtgtggttttagggagtttggtgactgtcaccatcagaaatgcaagtgaattattgaaatttccattattttctattcattattttgataggaaagtcaaagttgcagacaagcatcatataactctataatctttttaagttacctttgtttgtaactcactcatgaattgtccaattagcccccaaatcactactgacagtgagcttcatttgcttgtcatgaggactgcaaagagtagggagaatcggtgtacactacttctgctcaagtctcgggcaggaaagtactagtaataaattcaatggtggtgtcttgaagagaacagaaaacaaaacagattgacacactggtactgcttcagagaaagagtagaaaacaaacagcagctcactcagcaccatagaagaaaacacacatgcttcttgacctacaagggggtcgcttcctgataaacccattgtaagttgaaaatattgtaagtcaaaaatacgtttaatacatgtagtctactgagcatcattgctgagcctagactaccttacacatgttcagaacacctacatttgccaacagttgggcaaaatcatttaacacaaagactgttttattagaaaatgttgaatatgctatgtaagggcatcctgtcgcatattgctggcccgggaaaaaatcaaaattcaaagtacaatttctactgaatgcatatcactttcacaccatcataaagtcgaaaacttgttagttgagatatcattaagtcagggaccatctgcagttccgcattaaagcactaacacttgccattaccgttattcttcatttttcttccacagaaggagggtatccttacatgaagattgacggatgctaaagggtatgataatggtaatgatgatgttgataaaaattgctattatttacttagtattaactatgtggcagtctaattttctaaacattttgatgtgttaatagatttcatcctttaaacaaactagcgaagtaggtgtaactttcatcacattttgtaatgagaaatattaataataaaaagggttagcaaaatatccagggtcacaagctagaaaagtgcagacctggcctgagatgtgtctattgtgattgggtttcaaactttatttaatcattaacttagaagcagctctttcaaaacattgctaaattctgaagttacagagaaacagaaacaaattccaattgattttgtatttttgacaaccaagaaatatctcatgagagaatcctttgtattggacatcttctaaatactgaatacatagtaataaacaacagatagagagccctgtgctttggtaacatgaaatcgaccaggtgagtattagtatttcttacggcccaaccatatgggttattgatttgttctactctatccccatttcctgggtgagctcatgtactctaattattcaaagtggatgactcacactaattaattgcaaaaattattattagactacagtaatcaaaacaatacagaattagcatgatgtgacagacaagtcaattgaacaaaatactgaatctagaaacagatacggtcaattgaatttcaacaaagggatgaaggcaatgaaatggagaaataatgaccttaggaaaaaatgagactttaatctttgaatagtcatgcaaaaacaatttgagacttaaatgtaaaatatgaaactatagagaatgttgaataatatatacatgatcttgggttaggcagaaaaattttcagtcaaaaaagcacacataataaaataaatttaatttataagttgtacttttatcaaaattaaaaatatctgctgttcaaaggacattttaaataaatcaaaattatgtgccatgaattagatgaaaatatgggcaaaaatatgggcaaaatacatatctgataagtctgttattaagagtctatatgtattagtctgttctcacactgcataaattaccctgtctcgggtatctcacataaagataaattacccagtcttgggtatctcacataaagatacccgagactgggtaatttataaagaaaaagaggtttaatggacttacagttccaaacagctggggagtcctcaccatcgtggtggaaggcaaatgagggtcaaagtcacatcctacatggtggcaggcaagagagcttgtttggaggaactcccctttataaaactatcagatctcctgagactcattcaccttcatgagaatagcacaggaatgactctccccattatttaattacctctcacagtgtccctcccacaacatgtgggaattatgggagctacaattcaaggtgaaatttgggtggggacacagccaaaccaaatcaatataaatagcacttcaaacacaataataatgagacagacaacctactttgaaaaatagaaaaattccttaaaagatgcattaccagagaatatatatgaatgccaaacaagcatatgaaaagatgtttaacatcattactttttagtgaaatgcaaataaaaaccataatgagatcctgctatgcacttactggaatggcaataaaagaaaaagaggaggatgaggcggagatatcacaaaattgtgatgataccgtccagccatagaactctcatgaattgctggtgagaatacgaaattgtccagtgactgtgtaaaacattatgacagttcgtcacaatgctaactacttactaatcacattactcagcctgatgggcttttaggtaattatcttataggaatgaaatatatgtccttgcaagcatctgtacacaggtgtttacaacagctttattcaaaattgtccaaaagtggaaacaacccctactcctattaagtagcgaacagacagacaatttatggcccactcatacaatggaacactcactactgaacaataggaagcatgaagctctgatagaagcacaggatatgtctaaacatcaaaatcatcaagctaagtgacagaagaaagacacaaaagctgtatcatgtacaatccaatttatctggcgtcctagaaaattaaaagtaaaacacctatgtggatggaaatctaatcagtagtcaccaagggtcaggatgatgggaggagagaacacatatgagcagaagggaacttacgaggatgatgtaaaaaaatctctatcttgatggtggtggtaatcaaagggctgcaaatgtctctaaaacctgaacaaactgtaaacttcaatataacttttattgtagaaagtaagtttgaatttaaaaaatagtttggaacaaaagttaaacatgttagaaaggtatgaggaagtgattaatatcttgtaagaagaaaactgagtccttgttactgattcatatttttgagtgtgtgtatgtgtgagagagagagagagaaagagagacaatgacagagagcgagagcttgagattgtgagacaacatgagatggaaatggagataagcatggcatggtatgaatatgaggccagagtaacaaattgataaaagacagggaggatacaacaagaaatggacttgaagtctgggcgcagtggctcatgcctgtaatcccagcactttgggagggcaaggcgggtggatcacctaaggtcaggagttcgagaccagcctggccaacatggcaaaaccccatctctactaaaaatacaaaaattatctgggcgtggtggcaggcatctgtaatcccagctacttgggaggttgaggcagcagaatggcttgaatccgggaggcagaggttgcagtgagccgagattgtgccattgcactccagcctgggtgacagagcaagactccatctcaaaaagaataaaagaaatggatttgaacaaaagtaatggcattgaaaacatggcaggtcatatcaacagtgacttagaagatagactaagtagaatttgccaactcaatatgtatcattttataagtgaaaaactcaagatttcttccagcatatccaattttggagtataatcctaaagatcagagctacagaggacaccttgggagaaaaataaattcaatttggacgtgataacaccttccatagccttttttttttcattatagattaaacaattctgagttgttctgtactttctattattttggtcacatgaacaagatatagttttctgttgttagcagatactgggatttgataaatgttatatggttttgttactgtggtgggtaaaattctgaaaaatatccagcacacctttagtattcattcccaaactaacccagcctaaaatcaaataccagaagccatgcaatccctctccataacaggctacttgtactcctatgtaaactctcctaatcataattcttcactttctccctttggctggctgtgtactccatattgtgtttcagcctcttgaaatacagtgccatttttttctttctgacaaagtagcatttggaaacactaacatattaacattctggtcaagaaaacatctgcacagtttctgatactctttccttttccctttgctccctccctatgcactggataaaggcaagtttgcatctataaagatgatcattttattatttaatgaataatgaaaacagaaacctgatgaatattgaaaaagtattttctcattgaaattaaaatttaaagtatttgaaattatagaaacaaagtgactctattaggatgcgtgatatcaaaaagttacatttagattaaaatatacaaactacgagcatatacactgaccaaaagaagcttataaaagagtcttgcttgagtagattatttgcagtctgtttgattgtggacttctctctaaatgtggtcttagttgctttcatcaatggtggctgaaacaaatctcaggtttggtattttagtgtatcaacagaagtgaaattcaatttatgtggaataaattgcttttttattagcttcctatcgtaaacttctaattgcaaagacttccttgcaaggtggcccaagggtgtatctgtgcatctcttatttgttagacaatgggaactgctacatagacatttccaataaacctcttctgccccaatatttgtctcacccaactatcttaacaaccatctctttcctttcctagaatttcactcttcaaatatgtccttagagtttatagaaaacctgagagagactatcttggtgtagactccatttgctactaaaaaaaaagtatgaaattacaagattccgataaaatgaaatacaaaacattctttttaagaatgaagataaaataataaaagtacggaaagcatagaatggaggcatccagcatagctagtatgagggaaggcacgactaaagtgaaatgtgttagtagagcctagtgttctggcaatcgcaagaaaaacatgagtctattgggtcggcaaagtcaggtttagacaaaagccatctggatacagttccaaagaaagtattgcaaatggaaaggcattaggaaaaacacattaaaactcagtaatggataggactgggtttgagtgaaaagaggagaaggcggagaaggaagagtgacttacccggcttcactgtgccacctgggaggtgtagaagggtatttatatattttagctgcataggctattggcattaatattgattatataaaagtttgttattcaaacaaaattgtcatcccctatctacttctctcattctctgctaagaatctacatctcctcaaaacagagcactcttgaatggaaatacttttgcctacagatttttctactgttcttcatatttggttgtgtgtgtttgttttaacaaaattcgccaatttaaaaaaatcttcttagtttcaaatttctgttatgggaactctgaatcctcactaacagatacaatgacaggttggatattgggataattaatgctgagcatattgatagtgctgtaaatcttaggatattaaaccttgataacaggccaggcgcagtggctcacgcttgtaatcctagcactttgggaggctgaggtgggtggatcacttgaggtcaggagttcgagactaacttgtccaacatggtgaaacaccatctgtactaaaaatacaaaaattagccaggcatcatggcgcatgcttgtaatcccagctactcgggaggctgaggcaggagaatcgcttgaacccgggaggcagaggttgcagtgagccaagactgtgccactgcactctagcctgggcaacagagggagactctgtttaaaaagaaaaaaaaaaaagaataacaaatcatgtggataaaaacaaagaaacaaaacagcagaaatctctcttctctctcggtgactctgttgttattggagagaaaatggaaagtactgtagaattggagcctacatatttttaatgaagttctgtttcttggatccaggagataaattgagcatagcatgaagaatggtgaattattagtgatttataaaatgttataggatccttccagtcatgaggtttctctcatgtccccaagaagccatgacggctatgaaaaagcagtcatggtggtaaaattgtcagtgtatggtagccacagcttagaactcagtgaaacttagtgcaatttagtattgatgtcagggggcaacttccttcagtgtgaatcagttgatccaattaaaaagaggtgatatgattcccagttgtcaggcaccagttcggttacttgaatgcataaaacagaatgtttgaaaacagaatgaaactcatttcttccttaattgttaaagtcacacactagtcatgcactaaagtaagtttccagagacatttagctgtggggagactgctcatttatttatacattgctatttttgatgtaatcatttagagatattttttctaccagaattatgtagataacttgtgatggttaatactgtcaacttgactggattaaaggatgcaaagtcttcttcccgggtgtatctgtgagggtgttgccaaaggagattgacatttgaatcagtgaactaggagaggcagacccaccctcaatctggatgggcatcatctaatcaatggccactgtggctagcctaaagcaggcagaagaaatcggaatgagacttgactcggtgagtcttccagccttcatctttctcctgtgctggatgcttcctgccctcaaacatcggactccaagttcttcagcttttggattcttaggcttacaccagtggtttgtcagaggttcttgggccttcagccacagactgaaggctgcactgatggcttccttgcttttgaggttttgggactcggactggcttccttgccactcagcttgcagacgacctatagtgggactgcgtcctatgatcatatgagtcaatacttcttaataaaccccttttcctatatacatctgtcctattagtcctgtccctttagagaaccctgactaatacataattctattatattgaggataaatatggacttcttatcaacttatattttcttggcatttttattcatatgatatatgcatgtgacataattcttagataatgaatttttcctagaatgtacaatacagacttcaccttactctttccttaagggcaggcggttaggtttcgggggaagaaaaaagattaagtttggtttaaatccttgagagtctttataataatttttagacactctgaaataaatataaaatacatttttataaagaaaaatctccaaattatttttgcaattagctaccttgggctaaataaagcaatgttaggctgtctattagaattattttttgtagataattttttctatttgagaaagagaataatctatggcccaaataacattcagagtttaattaaaatgagtacattttaacttaaaacacattctgaatcaaatatagcattctggggggcaacataacacaatcgtatgataagatttgttaaaattgtgtctctaaataagatttatccatagtagttagattctactctcctttgttttgatttttcacaatctgtaagtaataagttcttctctacaagagctttctcaaatgccactttggttttagaacaatggcttacgaactgaatttttccccactatgcaaaagtgggcttatatgtgtgcatgtattgtggatgacactataaaccaagtaattcttggtcacagaatggagctttattagttggagttctttctaccctgttaggattattctatgggatccaatattctcttctacctctctctgggattggaaacgcagggaacaactcatgcatcggaatcaagattcagtaaagctaccaatgttctatctgcccaaagcacttctctcttaataagaagcatgaatagattgggaaaattcttctgtcctggagcatgagcagcaaaatggagagatgtacgtttggcttcatgtttatcctttcaaagtgatcatgtactcatcaactaccatctttcccgcatttagtctctgtgataaaaagtacacaatttttttggatcatgaagatggtctagaaataactgtggtgagaatctactattaagagtaactccgagaagtcatcttacaatacgatggcattttatgcaagttaaatttatataaatggtcaccgcaaccatttgcctatcactttcctggtcttactgaaaactttgtgagacaccaatttactctcaaggagatagtggtaaatttgtttgtttatttcatacacaaggcaatcttttatgtgtctaatactccttcaaatgatcattaatgcttttgtttatttaaattacctggctggaaactcctgagcatcttctgaatcttgctttcagttatggtctcaaagatgctgagtaattttggtggtgataaaaacagtgttgttttcccttaatcagaccgaatacccatagttacagtactattctacgcatgaggacatatagccagaacttttcattttacatatattttcaatcagtccctaatcagatatgtcatctcaatatggggctgtgtggatgtgttgactatgaactttagatttattcctaatattttattgcaaatatcttaaaattccaaacaaaaaattattatattttccttttgtgttttatctattacatcacagaaaatgtttgtatatctcaatatatatttatcaaaaagttaaagacatgactgcatgtatttgttttcccatttgtataattactgaccaattccttctttttctcattactccctggtgaggaagatcagccctttccaaaccaactcaagtttataccacatatgcaaaaatgtaaagtaactgttctctaggccacttttccatttgttcttcttaacaaatatttcgactcacttatcttccaaatatatctaaattactttacagatatattatacttcacattgtttatggtgattttccctattttgaaaatccatatttaaatcttttcaaatgcgtatgtttcaaatatgttgcttccattttcaagtatgtatataaatccttttgcaaacataattatgatcttttttctaacaaattcttctttttcctttatatcctaaaatagattctgaaaatggactagtggggtatgtgtgtgaagaggagggtcttagattaaattcgggcacttacacaaattctgtgaaatctatgtgtactgcgttgtggctgatgacaaatctcacccattttttcctgcatgcatatcatgaggaaaatataagagctacactaaaaaaacaaaacaaaacaaagcaagcaaaacacgcactcattggattatctgacaatttacatacctaaaattctgcttcttgtaaagtaaacataagtaaatttttatatgctagaatttttcacaaaggaatacattttttgagcggtagttttctgttatgacttctttaatcacaagggaaagttacgttcttatttgtagtaaaatattaacaaggataggtacatgacttagctgtcactgcaataataaataagctagaactgaaaaattttaaaatcaaatggcttttctctttgaaaactatgcactcatgcacaaacatgtcacaaacacaatcttggtcattttaccttattataagcaatataataaaggttggtataggctagccaaatcatatgtttatgcagtaattcttggcaggataggaaagaaaagttccaaacaaaaaagtattatgatattttcgctctgtgtcttactacctattacattacatctatatgttaattggaaaatgtttgtatgtctgttaatatatattcatcaaaaagttaaagacatttctcttgtaaaaatataaaataaatatataaaatacaataaaatataataaaaatgtaaaataaatatatatcagcaatttcatttaacctactgattagtgaaggaactagaaagatagtaaggcttgttcaaagagcacgtgatgagccgagcatttatgggcagttaataaagcaatgttagaatgaggttgctatgtgagatgtaaaattgcttaatattctgcaggacaaaaactataatctttagagttatcttttctactcagaatcattctgtaacttcattagtcaataggaaacaatgagtcaaacacactacattgtctaaaataacgcttgggtaaactatttaaacaatgtcttcatatggtatgaatcaatatgtttacaaacacttgttttatttttaagtttacaataaaattagtttaacagaatatatgtattggcctttactatttaaagttattatataatatttaataaattcacatatatagatttagatatagataagtatgaaacatggataaattatgaattatgttataaagattaaacagaccacccaatttacaaatactcatgctataaatatccttgggtcatctctggtttctttaaatcctaaggcttgaaaatttaaattttcctttgtttccgtattattagtcagggttctccagaaaaacatatatatttatatatacataaaacctatttctgtgtaagaccagagatagaaccatggctagtcagagccttatgtagctgataataacctccacaagagaaaggtaggaggagagcaaagaaattcaaaaaattaacaacacccttaaagacaaaatatagattagatattgcatatgagagtaaaagcaagagggaggacagaaacaaaattgtgcgtgtgtgagtgtatgtgtgtgtatgaagaagcttattttgaagactgagcccatgtgactatggagactaagaagtcctcaatcctccaatggcaagctggagacccaggaaagaaagtgctgtaatttcagtttgagcctgacggcctgagaactggggaagctgattgtgtaaattccagcccaagggcaggagaaaattgatatctcagctcaagcattcagtcagtaacaaaaaggacaagttcattcttccactgcctttgtttctatgtgggccttcaatggattggatgatgcccatccacattgggcagggcaaattattttactgagtccacagattcaaatgccaacatcatctggaaataccttccctgacatatctagaaatagcctttaatctgggcaccccttggtccagtaaagttgacacataaaatcatccgtcaccattcctattagattcccaaggaatttctatttaatgaatttaatttctgcattattattcttgctttacttgaacacatcaagcttgttccctcatcactgttgtgcatttgcaatttcttctgcctgtaactctctttctctaggtcttctaatggctttcttctcttcaattgggtctcagttaaaaatatctgcttagagaggacttttcttaccagtctctacctctagagctctattgtatttccttcataccttctaaaattgcttcgtgtatttattaatattaagttcctctttcaccccacaaaagtataaattctgggaggattgggatttgccttggctcttttatttctgtgttttcagcatgtagaatagatactgggatttggtggaaacccagtgatatcttttgattaaataaaagctttgtttgttttgttatattctactctgaaaaacctgaaggaccagaggtagatccatggatagtcagagccttatgtagctgatacaacctctacaagagaaaggtaggagaaattcgacctttctctgctttgaagcagaaaaattcaaaaattggtaatacccttaaagacaaaaagtaggtgttgtatgtgagagtaaaagcaaaagagagatcagaaataaaattgaatatatgtatatatgtttctattttatcttattttatattcagggggtgcatgtgcaggtttgttacatgggtatagtgcaaactgctgaggtttgggcttctaatgatcctgttgctcaagaagtgaacacagtaccaattaggtagtttttcaacccttaccctgtctgtctctcttcccttttagagtcctcagagtctattgttcccatctttatgttcatgtgtactgagtatttctttcgctcccacttataacaacaagtggtatttggttttctgtttctgcattaatttgccaagatatatatctaacatggaaagatggatggcatgacaggagtaatgggataattcaatttagtaagtatttttctcatttattatgtataactgattggttaatactgagatattatttggggtgatgtttccaatctatacgccttcacaatcattctcaatctagctgtatgtttttttccattggattcttctttgttgcttttccttgtagcaacactgaaatacttgaaacaattgcattaaaaaagtgaaacagataattttatgactttttaatatcatgaatcttgaaaatgagccaatatttataattcaagctagctatgtggctagtaaaatatttgactcagtaaaatatgctgattggtaaatatcaaacttcttcccaaggtatttgttcatttctcagatctctagtttagagtaacattcaatagttactctgttgttgaagttataatattttattgtgtgctcttgtgtgctttaaatttgcaaatctccacttacctctaagatgattaagggaacaactacattaccaattccttactattcaataactactgctatgcaataactactaaccaagatatacatagaagagattaacctgtgtcaaagacttggaatatatttctatgcaggagaaacagtcagtcattcagtgaccattctgtagtcttgaattgaatgcatgctgcatcttattttaggataaaagctaaagtcacttttgaaaatagcagtttccccactcatatggaactcttatcctaaataagtcttattttgtgaagaaaattatatgatctgtttactaaaaaagacaaaaataataaaaaatatacttcacatttaataataatttattctaacacaggtattattgagtttttaaaaattattttgtgtatatatttatgtttaaaatagttacagatatattagaatgatttaatcagttattttgtggattttagctgaaaaaatttggaagtttgtgtatattttaaattttaacttgttaatataaaatattttcctaataataatgatcatatccttcctaatataattttcactagataattatcacagaattgatgacaaagctgaaaatttcccacaactgctggatattgtcagcaggaatggcagtcatgcaacatataaacacattgtatccatctttctgtgtaattaccagagtttctttttctccataatgatattttcaaatggtagccaaactaataaattacatgttccatataattaataatatttgtaagtaacattttcataataacaatcattttatttttgtaaggaatataatgaattagcaacttatgtgtattaatgtatgctcagtggaggggatcacaggagtttacttgatttaatagaaattatactataaaatgtgtgattttctttggcttaagttatacactccccgagacattcatgtgtaagtggttccatgattcctattaggcatttaagcaagaagcaatgacctactgagtttacaaaattaattcagtgacacagcagggaaagaggaaaaacaacaacaataacaaaccctgcctcatcagggttcatctgtaatttctcagtaccagtatgctcagtttcttattaaatgataacagatcctaccaaggaaacatggaccatattagaacaatcacattagcagttttctctctagaaaaggatactgttctcgttgattcttgattcttaacattttccaattaaccgatcttaggctttatattgtcatgtgttcctcacatttttttgtatgtaaaactcagtgtaccttatttcaaagtgtccagatattttgtcttaatgttttaagttttaagtggtacatactcacacatacacatgacttcttacataaatgtcattcaaaacaaggcagagagaaggccagatgtggtggctcacacctgtaatcccagcactttgggaggctcaggtgggcatatcacttgaagtcatgtgtttgagaccagcctggccaacatggtgaaaccctgtctctactaaaaatacaaaaattagtcaggcgcggtggcatttgcctataatctcagctactcgggaggctgaggcaagagaatcacttgaaccagaaggtggaggttgcagtgagccgagatcacaccactgcactccagcctgggcgacagagtgagactcagttaaaaaaacaaatgaacaaacaaacaaaacaacaacagcaacaaaaacaagggagagagagagaaaaaaatgtggtatagcgaaaagactaccaggcagtagatcatgaatattacttcacatgtatattccgcgagcaaaactgatgatttctaaaaccacatcacttaaagattttattatctatatcctgtctattttcaagggttacatttacaagttacctatagccccaggtagcacagccccaggatttgatatctgatatacttaaatgattaagcagaaatgtattttttgttttatgaccaaaaatatctgggtaattttttaaaatgtgagcatgttggctgggcacggtggctcacatctataatccaagcactttgggaggccaaggctggcagaccacttgaggtcaggagttcgagaccagcatggcccacgtggtaaaaccctgtctctactaaaaatacaaaaattagctgggcatggtggcgggcacttgcaatcccagctactcaggagactgagacaggagaatcacttcaacccgggaggcggaggttgcagtgagccaagatggcaccactgcattccagcctgggcaacaagagtgaaattctgtctcaataaataaatgaataaataaataagtaaataaataagtgaccgtcttatcctatgtatcgatcattctctatatatcatccatatggcagttctggttgtacactgtccaacatgtaacacaatgcatggcactctggttgccatttcaaactgagaattttcctataattaattagcaattgaatgtaactataattttatcttatgtctgtatttctagatatatataaatacactagaggataaaataactattatgtaaatacagatatactttattatctcaaaaattacttattctttattttcaaatttgatgagaaaactacttagaaaacatgtttagccttttcaactgacagtacaaatttgataagatttttttctcttttgctgctactgagaagagtaccccctatttcaagatacataggatcaaatattatcaaattttcagagacttcccaactcacggaaatacttgaattgatttattaataagttcagcactaaattatttttattctcaatgtatgcgtagggaaagtgatgtattcttgccaacatgaagttattcattcacagcttcccttctaataaacaaagtgatactggaacgaagtttacctgtcagtgatatgtaaactacactaatggttctaatttggccaactaataataatgtgctatattttaaaaaaggttttatgaatgtggtggtgcacacctgtagtcccagctacttgagaggctgaagcaggaggatcccttgagcccaagaatttcaggctacagtaagctatgaaaaaaaaacaaagctttttgggtatgtattttgattcggcattgacattatcaagtaaagggtggagcaagtaagttttgctagtattagtttttgcttgtttgtttttaattataataaaataaaattaaagaaataggagtctcgcacaatagttaatggattcaagaacaatttccagaattccactttgtttttatgacatgactgtatttttattttgaaaatatttggaagtaaaaattacctataactttattagccaaaaattccaaagttattttattttaacattgattttctatgatacttatttttattgtcatattattcatgtcagaagcattatgtatttctaactattcttcttaaccttatctttttaaattgtgtaatattctattatataaatgtttacactttttaaatcattttcttttgatgaatctttatgtagctactaattttcatattacatatagtgatgcaataaacatcttttatagaaatactttttcatcctacagtagtttctgaataataaatcctgtgaagttgtactgctgtgtcaataattatgaatattttagagtgtaaaaggagctttctactgctacagagaaaatttcacagttctctgtccttagccttctctaaaagtttcactcataaaacattatatgtggtgaaatttgacaatgaacctatatggagccaatatatgtgtatatgtgtgtgtgtatgtacatgtgtgtacacaccttgagcttctgtgtgtgttaagctacaattgtttgaaaagtttgaaatatccataggacacacacacacatacatattgattgagtacattatttttcaatctcaattgtctccaaaatgtgatcggttttggaaaataaatgtaaatgtatattgtaagaaacaatattgacaattccaacacctttaatttgattgaatttaaaaaatcattccagtaatgtaaaaaagataacatattaaaatgtgtaatatacctcacctttacagaatagaattttaggtttatttaataaaacgagagagagaaaaaatcagtttgcttgtcagtactatttagccatattcacgtgacccatataagaagtacagtttcctccacagaggcaaactgtaagatcaacaaaaaagaggttcaagtaagaggtatgtaatataacccttaaaagagaaaggatcattaacagataaaacttggctgtaacttgattgaatgtattgatacatacaaactgaaacattaatcagatgacatgaataactaaagtaattacataagaagtatttctagaggtaatcactggtagtgcctatctaaaacactgtccagggatgaatgtgtcctaacacataacaatgtctctagcttccagctctgttgaattcatagtgtatctactgacataacatgaatacccattggaacttgaatttggaccaacacaaaatttactataatttccatgttttaatcccaatctgctgcacacctatattttctgtcctttgattttaatcctaatctatgctgtcaacatgtttctatttgttcaggccagagctttataatcattttagccacaatattaatttttaaacacctgtaaaagccaacatatattttgaaattaccttcacaacatctctgactttttcttgcctacactatttctataattatttagttgagatctcatatccttgacctatcttccctaaaaatgttgaaaaaacatcattatttgagttaacatatggtcatgttgtcttctggtttaaatcatgccaatgtttactacttttctattagctgtgtccaagatgcctatcaaagcacacaaagtcattcacaatgtaattggtctgactggtaagcttctactcagcttctcaacccttagtgttttatgatctagcaatacaaaatggtttattgttgcaggacaatagcacaatgtgtcacatagccagaagccttgctggatccctcttcttgttatcccaggatttgcctggctgtctacacgtctctattctgtagatatgtgtgcccaatatgccaataaacactgttttataatctcatactttttttgctattgcattattgaattgtatattaatttatgtctttatctctttcccttaatatacagtggtattttagagagtagcaacttcatataattttctgctaaatccccagtatttactctggtgtctgtcatgtaacccacactgaataaatatatattgacttaaagataaaatgtattattgtcataattaaccaaaacctctttgaaagtattgtggcattatttttttttgagacagagtctccctctgttgcccaggctggggtgcagtggcacaaccttggctcactgaaacctctgccttccgggttcaagtgattcttccacctcagtctctggaggagctgggtttacaggtgtgcgccaccaggtcaggctaatttttgtatttttaatagagatagggttttgctatgttggcaggattggactcaaactcctggtctcaaaccatcctcccacctcagcctcccaaagtgctgggtttacaggcatgaggcaccacacctagcctgcaatatttaactctttaaaaatcccggtctactaaatttaagcaaggtaatgcacaataaaatgaaggtccaggaaatcatgtaaggttttatcacgatacttaatctgtgtagcaattacacttcacatgcagagaataaaaataactttatacacttcaagcagaaactgattacagagatttaggtgcttacaaaattgtcgagaaggctatagaggcagcctctggttttggcctgggcaaatgcctttctgttcgtcaccacaaaacttgcccaccaagaaaattactactaggtacttgttccaattgccagatacatgactgcaccattttgtccacattctgtagataaaatcaactttcataaattttgtcttcagaaacacacatgcttcagtctgggaattaggaagcagattccagatcacttggctccagaacatgctgtttggaatcctagctgtcaataacataagaatgacaaacattgcataattccatttatatcagcggtctaagccattcaaactcttggtagcaaagaatacaacaatggttgccaggggcactagagagttgttgttcaatgggcataagtttcaactgtgctagatgaataaattctagagctctgctgtgcaatgtagagcttacagtcaacaatatggtatcttgcactttatttgctaagagtttggatcttgtgttaagtgttctcacgaaacaaaagcaaaaagaacccccaaaggtatacaaggaaatcttgggaggtgttgcatatgtcgattaccttggttgcagtgagggtatcacgggtgcatgcatattccaagcttattgaatagtacacatttacatatgtgcagttctttgtgtatcagttatacttcaataaagttgcttttaaaaaataaatcctagtgcaaggtggtttaggaaatgtactatatatcttttctgcagttgcagatgacaggctgaaacgaaattggaacagatggcttatctaacatttctgccataatctctctttgcaacaagagcaaaagcaaccacatcataatgatactgctagaaaatatgttaatatttattattaaaagtcgcattattagttgtatgtatgtcaaaaatatgaatttaattatctattttacagttaaaatcaaaagaagattgaatatcttttctgcataacacactgcaccaaatgtaaacaaaatatctgtacctcctaaacttgcagtcaaaaaataaacttcaggccagtcatggcggctcatgcctataatcccatcagtttgggaggtcaaggaaggaggatcacttgaagccaggagttccagacctgcttgggcaacgtagtgagatctgctctctaccaaaattttctttatatcaagtggggtggcactagcctgtagtcttagctacacaggagtctccgagatgacggaatcacttgagcccagaagtttgagatggcagtgagatataattgcaccactgcactccaggttgggtgacagagtgagcccttctctttaacaataaataaatatgtaataaataaaaccaaataaatttaaattttactggattcttccaataatatatgctatacaatcttaatttcacatacataattcacatttgccaatactccttttcccattataaatactttggatttctgagtatatatgtatatcttttgaatctcctttttcttttgtcatttggaaatataggcacatacacacgtgcacacttatttattttataaaatctataaatttctatacctataaaatttattaaattatcaaataattacatggcatgtaattatgatttctctagcttaatttgtactctttcctgagattctccaccttcaatttcaaactctttacccaagatttaaacggccacttagtttaactcttgtgcaggacttgaatacagagtcaggcaattcttgctatacaaaagcacgattaatgcttcatgtagcttcacctaagaatgtctttacaagcctgtgtaatcatttagcacagatggtgaaaatctgtaacatggaccagttaccataagcacagttgacctaatcaaaattaacactcacattagaaaagtttattatccattcataaaattcagtggtataacataaatgtcatgccaccttaggtcttgcatcagtaattgatttgtttatgatacaaactaattctcagtattttgtctctttcctgacaataacaagtagaatcatgaacagggaaggttattatttactagccacagctcaatgtaccatgtaatcaaatcctttgtcagagcatcctgccacataatcagatcgtgtgaattgtcaaaggcaattttataaatatatattcatttaaagcctcggtaagcttgttatagtgtaggataagttcgtttttctttttttttttttttcctctgttgttgtattctgaattcttgtgtatggagtaattacatttcttaaaaatataactcaactgtgaaaaaataataaattctctgttcacctataataaatattccccttcaaaacccaacacattaaattattatgatgcaatttgcttataattttctcccaggatcacttctttacaagatattttaaatgtatttttctgaaatttcaataaatatttttgctgagccacgttagagtttaataacaatgcactacactgtcaaaagcttatcaaaatgtgtttgggtatattcgcgcagacactcatacccacacaaaattacactagtttacaaagagcaagtttctatgtgatttgtgactctgccttagtttgatttgtacctgacaggcagttgaacattcttcaggttttgtttaacttggtaacaatgagcacctgtcttcataaggttcatggtattgatttaaatgactaaggaaaaaatcaatctacacttcttttcagaggccaggtgactcaccactaataatgaaaaaggtatttcatagttattcctccagggcagaaattatatcatctctgagaaataatagtgaagagataagcctctagtctcttaaaaattacttatgtgccccagaaaattatccaggagacatttcttcattcaacactaactttacaattattaaatatctattattgcactctgggcttttaagaggaaataggacatgggggatttaatctatgtccttagcgagtgtaggttaatgaaatctacacaaaacaagagaacaaggagggggaagcaagtgaaagtagagaatgagaaggaacagatgttagtggttatgaagcagccacaagggcattttgggcaaatggaagtgttcgaagaaggaactaattgataatggtttggaagagaaaatgtaagttagactttctaggtaaaagctcttggacgtggccttatgtgttataggatttagtgaaagggatagaatggatagaatgtttttggttgggagaatctctttacctactttcatactgtcttatgtccaatgataatgtaaaataattataataattattcaatataacagttatgtgttaatgataataaaaatataataacagtaacagggacttcctcatgtgcaatagtcttgatctcttgcctcagtctcttaatcactccctgtgctaaaggcagtcacatatatgatggtgacttgggcacaagcaaagggcttgtttggagaagccacgtcgtatcactttatgaagatcctctgcctgatggcagcgtgttcatctctgctgtatatgtgggcaggcccatgcaggttggctatagttgttctctaccttcagtacagcctgtgaccagaaggcatgtataagttaagttcaaagtactgtgatagagtaattggacagggatctcctttttcagctttggagaccccctccttctgtctctgtacaggggagcttcttctttctgccttcacttttctttctggcttattaaactctgctccttaaaaccaaaaaacaaaaacaaaataaaaaaaacacacaataaataaataaagtaattggacagtaattttatggccaaacaataaaattagtaataattggcctggtgcagtggctcacgcctgtaatcccagcactttgggaggctgaggcaagatcacctgaagtcaggagttcaagaccagcctggccaatatggtgaaaccccatctctactaaaaatacaaaattagtcgggcatggtggcacatgcccgtaatcccagctacttgggaggctgaggcaggagactcgcttgaacacaggaggtgaaggttgcagtgagctgagattgtgccactggactccagcctgggcaataaccgtgaaattttgtctcaaaagaaaaaaaaaaacaaaaaaaaaaacctagtaataatctccatttacctgaatcccatacctgtatttttaatccagcttatccgtgatcagggaaaacacagtgtaattatccactgggctccccaaatgccaatgggcttgtaatttaataatgagaaaagctagaacacaatacttttaaggtcttttctaaattttgatgtttgtgatttatccacatttaaacacaaatgccaatttcaatctcacaaattatgtacatatagcatgaaataggcttatatgtctgttattactaacatacaacaaatctgtaaagtaatccttgttactgagaaaagatatttctggtctaaaattcctgcttgaaatcataccttcatctacatactgtttgatgatgatatatactacagagttctacaatccaacaagatctccatctcatcgtaagaaatagtgacattttaattttgttctgtgattagatgaatgctacaaatgtacccgctttaaacaatttttggtctcctcttaaataaaagtgacacatttagaaataggaaaattttgtctcattctctaaaacaattttgtgcacttttttattttaaaaattcaaatttattacaaactattaattagttattagcctttgctttttggtaaaagcattagtgcaaagtttaaaagcatatgaatttggaaacaaatttattttcttccattttaaagagaattttcttaatctgaacaatgccagacaggaacatgtaatctgtattctttttttgaactaaaatgtgaccttttacctatggaagaagtcaagggtaattcaccctatagggtttgagaatttaggttctcttaataacaccacccgtaataagcatgaggaagacactaatggcgtggatcctagtaaagttacttcagcaaataagtcgagagagaaaagtccatttttgagacctctattaactgaactaaatagcccagacttactcccctattaaaaacaagcagtaggcaaagcatggtggctcatgcctgtaatcccatcgctttgggaggccaaggtgagagggtctctgcaggccaaggcaggaggattgcttgagcccggcagttgaagaccagctagagcaacatattgagatcccatctctacaaaaaattttgaaaattggtcaggcatggtgcctgaggtcctagctaatcaagatgaggttggaggatcccttgagcccaggatttttaggttacagtgaactatgatcacagcactgcactacagcctgggtgacaaagcaagaccctgtctcaaaaaaaaaaaaaaaaaaaaaaaaaaaaaaaaaaagcagaagttctggacaaatacaaaagtcatctgcatttgcattaaagagctagcaaaatagtcagaaattaccaagttaaaagaaggacagtgcctactttggggacctgcttttttgctcaaagtggtttctagatgctggggcaatggctgaggcgctgagcagcacgcttttcagaccttggagaatgggtgcgctaggattaagggggacgggaggaaggtagctctgttcagttttttaggctctcaagcaaagctttagttaatttttgcaataaggaaagtggtaaatttagacaaaacaatgagcttatttatctgcacttcttttttcttctgatctcagtccagcatttccttgttgtttcagtaactttcctgtacctttaaaaaaaattattttaaatgttcattcagatagtctattgagtatgtcagcttagtctgcagttgcctgaagaactctctccaaaatgaatagatgagaaatagatgatagataaaagtgtagacgcttgctagctataaccacaacaatagacataggtataggtacatataaatgaacaaaaaaaggccgggcgcggtggctcacaccggtaatcccagcactttgggaggccgaggccggtggatcacctgaggtcaggagttcgagacccgtgtggccaactaaatatacaaaaaaaaaaaaaaaaaattagccaggcatagaggcgtgtgcctgtaatcccagctactcaggaggctgaggcaggagaattgcttgaacccaggcagcagaatttgcagtgagctggggtcgtgccactgcactccagcctgcggaaaagagcgagactccatctcaataaaaaaaggaatataaataaataaataaacaaacaaaaaatacagtgatgcaaaaaaaaaatcatggtactattccattaaggcaaaaaatcattaaaaaaatttaacatacaagtttattcatcttctctttatcttatttctgaggctatcaagtggtctttcttttcctaaagatcaatttcatgttcatcttttactaagaagaaagctctgagttggctcttcttctttagtagtctttttgttgcaggatgagatggaaaacaagagatggaagaagaatagtcaccgcatttgaaatcatgcagaagatgtgggagttagggaaaaggaagcagtgactgaaaaagattactgaagttttggtttaataaaacattgctcttttccctccccccttccaacccagcaagcaagccctttaattaaacatacaatgaaaaaaaagtcgggtggatgtattcaacttctttgatttctacaccatgctccgaatttcaaacctacatgattcattacctgtttatttaaaagaatagttgaaggtttaaatggaaagaataaagaccagaaaagacaaaagtcttttatttatgtatttatttattcatttatttattttttgagatggagtcttgctctgtcgcccaggctggagtgcagtggtgcgacctcagctcactgcaacctctgcctcccaggttcaagtgattctcccgcctcagcctcccgagtagatgggaatacaggcacccgccaccacacacaactcatttttgtatttttagtagagacggggtttcaccatattggtcagactggtctccaactcctggccttaggtgatccacccgcctcggcctcccaaaattctgggattacaggcgtgagccactgcaccttgccaataaaagtctttaagactgagaattaaaagctttaaggttaatggcaaaattgtactcttcagcttccccgtgcaatccaatacttaatttctataacgttactcattttatccactagattcaatgagggtgctctgtgcttcccgccacctgatattaattgtgtaagctggtattctattggccagatctgacaaatgtgagaaaatcaataaattacaattttggcacatattttcacatgttaatattctcgatctagaaacaaaaagagaaaagaaaatagtaaagtggagaagaaaacaggctcttcttcatatatgatgcctgttatgtctcctgctgaaagagaacaacgacaagaaagaaaacatggtttccaaattagctgagaaatattttttgtcatagtgatattctttgtcttaattgtaaaacttcttgtttgaagaaaaaacatattaaggaatgtagtgtgacaaaacccatttcacaattaataatcttaaaatgtcaatgatataaacccaaaataaacttttgccgaaagtttagatgtttcaaaggcccaggagtaaaattaaacactgctgtgcgtgccaataattcattttctgaaatttaagacaaatgggagtgaataagtaagaaatggaataatagaatttgttaaatattacattttgttaaacaaaatatagattactttctttaataaactgatttgcaaacacttttatttctttactcttagaaaaagtttggtcacgatatgtattagtccattctgccaaattacgggggaggcacctcctctccaggtagcaggagaatgagtgccaagcaaaggggaaagagccccttataaaaccatcagctcttgtgagaactcactcactatcacgggaacagcatgggggaaccactcccatgattcaattatgtccacttggtctctcccttgacctgtggggattatggggattacaattcaagatgagatttgagtggggatgcaaagccaaaccatatcactactgttttactcctattgcaattaatttacaaaatgttaatatacatatacacctacacacataacagggaccatacacacaaaggaagaggagagcgagggagaggggagaaagaaaaaaacagaattgcatggcaataaggcaatcccagtcccaggatatcggctccaggaagtcaatagaccctcttaaccttatttcaatgatgaggaaacaggctaataagaacagttaagtaaactattttattaaagttttatgttcattaaactaaacaaaccctttctagtgatttgggttttcctaacaatgtacctatccattaagtattaattactgtatgcaatttcaacatgaatgttgtgtaagcaatagaaatatctaagcttctgtttcttcctctgctaagtaaaagaatactaatgtgtaccaatttacctctagctctgtaggaactgaaatagctagtgttctttctctacattagatagaaagtatcagaatatatctattgaaagtaaattgatgtgtgatagcactggttcttgagttttacctcgaattttgctaaaaatatgcttgacgtccatacccagagctaaagatttagatacatataaataaatatactactgctgatcaagatatttttattatgaaggattatagccaaacaatgaaaaaatttcatatagagaacaatttaacttaatttgagtagctatacctgccgtgtctgcaagtataatttaattaaaagtggaaaacgtgatatttgggtaatatggttttgaaccttttatctaattaccaactgtaagtgcactgacctcatgctgctactaaacaactaaaataacacaaaatatatttccctaatgtttcttacaaaataagtgcagataaccaattataagtaagtgtttactttcatatttccatttaagctaatatatacatattaaaatttagaaccttagaaaatgttaaattactagacttctgtattaacagaaaacatttatcaaagcattatttcagaaaagctttcctgccttccataaacttgtttgaagcaaatgagggtttgaaatgaagataaactctgtgaaaataaactacaaatgtcaaaaatgttgtactttcacaaaagttttaaaattttcattgttttgtgtttgttctcacagagataataactgatactttggtactcaaatgcaacctgcttggagatggtcaatttatttattaaatttggcatcatatatactcttaattgagtgtgttagattttatgtaacacatttatgctatgttgtcttctgatatcccactgtcaggttatgagtgtcagaaaattagaaattttatttctaatgaataagaaatgacttacctgtattccaactttatttgaaccaaaatgtgaagatgtttcaatgatattatgtgattttatgataacagatgataaccaaggaattgacaatacagctactcagaagtttttttacccaggccagtgatgtttttatggaggcctcattatgtagcatgagtaattaaacctctggccattggtgatcaacttaccttcaaccgctctatcctctcaagagttttagggggtggggctgcaagtcccaaccctctaatcaagcctctgtctttccagtgactagctccatgtcaacatcagcatacaaaaagacagaacttcagagactaagaattttaggagttgtatgacaggaaaagagcccaggaatctttttgccatttcttcctttcttaatctcctgtatttttctctttatttatatcctgtttcttatctccctttaaagtttaaaaaatgaaatatttttgtatctgtttatcggttgctctaccaaatatcaattcaaggagagtttaggtgcaaattttgcactttttaacttactaaaaaagagacagtgttttttcttcaatattaatatctatggatgtatctatatatattagattccaatgtttaatcatttatgaaatgcatacatattttataatatatataaataacatactgtcttctaggaactaatctcatgatagaaatgcaagtatatgaaaagaaagtttatttgtcatcaaaatcaaataatctagacaacataaaaacatacctagaactataataaaaaaacttacagattacactggagaagtgtaccaaattgtctgagagtacaagagaaggaggaggctctacatcttcctggaggaatggggttacaggtagggagcagaaaagaataaaatatttgaatggaaagccagaaaatagtgtggtttttttggcggggagcgggaaacggagtctcgctcttgtcacccaggctgcaggctggagtgcagtggtgtgatctctgctagctgcaacctctgcctcccgggtccaagtgtttctctgcctcagtctcccgagtagctgggattacaggtgtgcaccaccacgctcggctaatttttgtatttttagtagagatggggttttaccttgttggccaggctggtcttgaactcctgacctgaactgatccgcctgcctcggcctcccaaagtgctgggattatgggcatgagccactgtgcccggccgggatagtagtattctggcaggaagactcgcagtgccgggtgctcagatgaggagatgaacgtgaatcctgcctaacactgaaagatgaagttgaggtcagggggccctgagcccatgagtgtatctagagcttaaactgtaaaagggggatatggtcaaaaaatatgatggaaacttaagcaagcctgcaagcggtaatatgtctggactttgttttcagaataaatgaggagtcccagggaaaatgtggaaggcaatatatgatttgttaaaaatagctcttctgcatttatgggaagcattaattagattgagggagtggagccaatgagaggctggggcagccgggatcctaagctggtaggttacagtggagtcatttccacacaaggatttgagtctaaatttataacctcaggtataaaaaacctatagtcaatatttcccatgaaaattagttagaaatatgagattttagaagccaaaataacatttctccagaactataaaattcaagcttctgctagttaggattttacctttgttattcactactgagttcctaggacctatgatggtgatgcctggcacacgcctcatgcctagtaaatattggttgaagaattagttaacagtagacaagttgtcttcttgtgttggtagagaaagaaaataaatctgtttgtttatttttctgcttagcagtagttgcagtagctagcttactgtcaaggttcatactgtatatagaatacattttttcatagctcaggaagatgttcaatgacaaaatatttacatagtgggagacatttgggatctaacactgaaaaccaaaaaacaaaaaatcaaatcctggtattatgctcactgagagaagggtatcaacccaccgagtgaaatggagagatacatgtaatgtgtgaccctttcctttctcttttcctccctttcaatttctccttctctctccacataatgagtttaattttaatacacagtgttcatcttatgtgaatccattgttttgcaactattttatacaaaggatttatgatgacttcaacatggctgttccaatagaggtacagaaaatgggacaatgatgaggaatattttagcgattgaatagataagacagtgaagcaattgatttgtatgaaagataagagaggcgctagtcagagatgtttgtggcatgggcaaattgttggtcaaagctgccattcatgagtatggagacatacgaagaggggcacctttattgctggaaagaattgtaatgatctactgatcttaacgtaaatatgttatttttaaataaaacttctatgcagattgatttttttaaactcaagaggtctgaactgaagaacaaaatgagaaagtcattagtgtatctggtggtatttgaattcatctatttggatagggtacatcagggataataatatagcctgagaagagaactctagagacagagctatggggagcatcaaagataaaggagtagtaaaaaaaaaaaaaaatcccaaacaaaaagtagccccaaatcatggggacttaaaggagaaacaaaatgaataattccataggagaagaaagcttttaaaaacaaaagttagccaaaagtagtatgaagtgtgaagaaatgaaaaaagaaaggatccaaaaaaatacttgttctggccctaagagtttccttgtaaccttggttagatcttttcaactaaagtcttaaagaaaaattctggcattttcccttctggtcagaagaaatcctataaatttactttgctgcaaggacctagaatagagctttccaagctggtgttagaaatgagcaccacaaatcctcagctattgatcctccccttcttgttctcggggacccgaatagatcctgaggtcctggactgcaccctctccctttattctagtgggccacctttgcatgtgtgtcattctgtgtgtggaaagagcgagagacaatgtagtctgcatgatctagctatcatgtgcctctataatcacactctctctgattttttctgtttctcattcttgtgagccaggctggcctccctgctagtcctagagaacagagaagaaaagttatagaaccatctgatcttcctgatcttcccaccctacacacgtgacttagccatttctttttagttccttataaaatgccacctccttatgaagtattttcttacctaggatagcatcccccatactgtctattttttttcttcatagtacttaccactacctgacatagtttaaatcagtgtgtttgtttataacatatctccctttccatgcaaaatggaagtttcaggagactaatgtgtttgtagagtttactgttgcattctagcactcaaaacaatgactaagatatagtcagtgctacctattggttgaccaaacaaaagaaacgaagagtatggaattcagacagcaatgctttatgagcaaaaaccaaaactaaatgcttagggttgaaaaaattttaaaaagcagaccattctataatagacttgaactgtaaaattaatccttgtttcagcacatttgtgttataaatccatgctgtatttgtgattgcatgtgtatgtatgtgtgtgtcacagtcatttctctcaaatttgcaacaacttactttataatggaagaacagatctgtatagtgatactcaattttatcatttagataagtgcttaccaaatagagatgattatcatagtcacctgacaagatttcagacatgttcccaactatagtcccagtgattcagactgaatacacctgggattaatatctgaggatcttcatttaaaacctccctgggtatatcactaatcctctaggtttgaacatcattgttgtaataatcactatttaagggtctgacatatggaggagatggagtcagacatagctggtgacttttccaaaaaaaattaagaatttgaaggaaggataggatttgggtagcactcagaaatagggagaactaaggagtcctgataaggtaagttagcaacaaggaagagggggctccaaggtggaggagaacaattgttctgagagatggctaaccacaatcaactcactggcacaacattttgttcccaaataccttgctcctccacgtcgccccagcaacacaaccctatctgcatacagcctctctagcatgacctataaaacttccctcctgaccctgcctcttggcagatagcaccctctctgctgtactgcctgttgtactttttcaatgtattttcctaatttctctctaatatacttactttctttaactcactactgttttggtacattcttttactgcccatggcactgacaccagtcccagccagtcataacccatgacatcttggtggcccatacagggacctctcccctactctccccttttctcctctttccggggcacaggatccaaacccagaaacaactgattgtccctgcctgagcctccaagcccagagacaacagatggtccctgtctggggctactccttgatggacctggaggtcctggtagaaagatatctgaccactgtggcctgattgggtgagagtttaaaacttactttcctttccactcttctagtggatgatctccaatatctttttttttttttttttttttttttttgagacggagtctcgttctgtctcccaggctagagtgcagtggcgcaatctcggctcactgcgacctgcgacctctgcctcctgggttcacgccattctcctgcctcagtctcctgagtagctgggactacaggcacctgacaccatgcccggctaattttttatatgtttagtagagacggggtttcactgtgttagccaggatggtctcgatctcctgaccttgtaatccacccgccttggcctcccaaagtgctgggattacaggcgcgagccactgcgcctggcaatctccaatatctttcagtcaactaatggtaatgggccagggccattctttggtgtagcctaaaggccagagggtgaacagctttggcttccttctctggaaaggaggaagattctctcctattctttcttgtcaaaagtcccccttccctatgtgtggcacagttggcagtggtagcttgacaagcgcaaacctacacacatttgggaaaactcacatcccctcttctcactctaaattctcccataaagacagtcagccaacctgtttcggatattttaagccaggcagtctcaaacagcaccaggaccataagtctttgctcagtcttttccccttgtacctgaactggtcatcctgagtaattcttacctgcactggtctggggttgctcacccattgttcgctcatcataaggtcctagatctgggagatccttttccataggtgggatacccccttggaaagtgcatctcagagtccctcagcggacataagtggagccccctttcctcagtgggatgccccaagagaaatcatggttagagtccccagcagacattctttcccaccacaccatgggacaaatcccctccattttctcagacttggctctgggttgcattttaaaacactgggataaatttgaccctcagactctcaaaaagaaacatctaattttcttgtgcaatacagcacagccactttataaacttctgcatcagcaatcctggtctccaggtaggaaccacaccaccaacaatattctttagcttaacttcttctgttgcaactcttctgaatcgtctgaagtttcttatgtccagcctttcatgactttttcttgggatcctgatctccaccaaacctgtcaaacgtgcttggccaagttctctggccccactgactcttctgccattttagacaacccttctttcattctctctcattctccccaactggctgggccagttgaggacacaccttcttcccctgacgaaccacctttacattcaattacacctactctatctgctccttatccctcactttcccacaacatcccaaccctggatgtcattttccagggtcttgtctgtatcagaggcccttctccccttcacatactaggtcaggggccacctatgatcccattttggcctgtgcgtcttcaacttacttgtcaaatttgtctcttctagaattcagcagtttaaccttcaaatgatgctgtgaataggatatcagtctctcctcaatgatgtccgctacctttatgaatttcccctggattcagctgaacaccagtttcaccttgaaatcccccacccactcacccttgagtcccttcctccagcaagatccaatatcctaagttctacaattcaggacaatgacccacagggtctcctgacagaccaacaaccacaggtagggtcaactctatgctccaggccagaaggcagccactggagatgagaactttgccccagtgccaaaaattcatcatttttgttccgttgttggttgaggagaaatgtggagtcttgataagacaaggtagtgagaatgaggagggggccccagggtggaggagaacaattgttctgacagaaggctaactatgaacaacctgtttgcacaacattctgttctcaaatacctcactctgccaagtaatcccagcagcattaccctatctgcatgtagcagctccagcacgaccctataaaacttccctccagcccctgcctctttgcagacagccccttctctgctgtatgacccattgcactcttgcaacatatcgtcttactttttttctaataaatttgctttctttaactcagtgctgttttggtaaattctttaactgtccgcaatgctagccccagccagtcacaacccacaacaattagtcaagaaagaaaaatataagaagtggcttctacttctttaaaaagataagccatcatgagctactgttcttttacttcaaaatcaacatacagaaatgacaaaggaagaaggaaattgaatcacaataatgagcaaaattagccattatctatggcttacaacagaacacctgaaactgggtaatttataaagaaaaatactttatttcttatagttatggaggctgtgaagtacagggtcaagcgagtgcatctggtgagagtcttcctcatggcagggtctctctgggtcatctccaggcagcgcagggcatcacatggagaggggctgagcatgacctgtgctagctcaggtctctcttctcatgaagccaccagtttgcctcccatgataactcattatttcattggtccatgagtgactctgccctcacaatccggttgccttttacaggctgcacctatcaacaccaccacattggagatgaaatttcaatatgagttttggagggcccccccttcccataaacttgaaagtggtatcgcattggggtgagtgtggggtggttggctgccgcacagggcagtgtgagctggaggaagcagtgagaaaatgcaagagaaagcttttcaggttgtgccactgcctcttctcagtgctgcagaaatggatggcaacagctcaggctacagaggcaatgtttcacaggcagaggtgtacacagtctacattggggccaggagtggatgacaacagagagggacagaggagacaagcagggaccatcatccctttattcttcatctgacagctgttctccctgagagtttttaaggtgaaacctgggaccagaggaaatacactggtgaggtggctgcagaagggagagatgagcagtcttctctagtgtctgggaaattcttcagtgggactctttcccgcttttccccataaacatacccttatttttaaactcaacataaacggtagttctggcttcacattttctgaaatataataccttcgtagaaaccagagctgccatgtctaggagaggagaagctcatgggctataaagagaccccctgcctgagaagtaaaactcttggaaaaatagaacacagactaaaacaattggtatcatctgacacaaaattactgaaacatgtgaactaagaatttaaaatagtagaataaatgtacctagagaaataagggaagacattagcagtataatcgagaacaagaaggcttatggaaatattagagaggaaatgtatttgttgaagtgaaagacaaaatagatgagaaaatcgtggaacagattttgctgcaaaattaactgttaaactggaaaaaggaacactttcgaaggcaataagagagaataaagaatattaatatagtttaaataaatgaaaccagaaaataagaattttgaagaaaaatatgatacatacagataaggaggtacttcaagaaatatggtaataagttatccataatttaagaaaaattaaatttccatttaaaagactcatagaatgccaaaaagaagagaagaaaaatcacacaagcaaacaaattttagttaaatttaagaacattaacacatttgtaaaactttcagagaaaaagaacaaaccacccaaaaagtgacatgattcaaaaaagcatcaggcaactcaacagcaacactggatataagaagtcagaaacaaaacaaaacaaaccttcctaacataaatatttcttttttagaatcaagaaaaaaaaatgtagcaaacgagtaaagaacatgaatagacatttcatacaaatagcccttagcataatttcgagcattataagaaaagtgcaaaataataaaactacattaatataaaagtttttacctactatattgcaaaagtgtttacagcttcacaagaaattgaagagttgtggagacagctatggaaatgaggttctctcattcctatgcaagacttataggaatgctaaatggaatactttcacagaagaaaatgtggccccaaccagcacaaagacatatacatttgacctttgacacagacacttcacatataggtaaaattccaagcttctattttgtaatattgggggaacacccacaagtacctatttattgttgcagaatttgtaatgtcagtatattggaaaacacctggacccccatgcagagaagaccctaggttcagatgcacacaatggagtactgtgcagcagtaaaaaaaaaattaggaagctctaatcagtataatcagctaatgtggagtgaaaaatagcaaggtgcagaatattattaagcaatcaaatatagttaaatgcattcatttgcttttgcaacaacaacaacaaaaaaagagagataaaaatagcagagaaagagaaagcctaatgtgaaactaacaagaatgcttattaagaatgtaggtgaaaattgagcagaaggtagttctgatttaacatctgctaatgatgcccgtgttcaaaaattaattatttaaaatgtaaactaaagttaaaaggagattaaatactttaaaaacagaaaaatacctaactctatgtcaaactgataacctaactacaaatacagggagttaatgtaggtaacttaaaaacacagcactacaattactcacccttagtaggatatgtaaaaataattgcaaaaaaatcttgagatgtatttaatatacgtgttgtgaatggtggtatgggtatagcaatttaaaacgttcttttttgttgtggggtagatcaaagagcaaatacatgaatatttctgggaactatgactaccactgtaggaatttggtaaatagagcagaaataaaatatgactctataaataaagctatttatgaatattttgtgaataataaattcagtaagtacttcaaattagtgaaaaagatgaaatattcagtgaatcgttatgggacatgttacaagctctttgaataaagtgttggatcgctaattcagtctttacaacagaatgtatttcacatggatcagcttatacacacacatacatacacatgtataagcttataaatatgtatatgcacgtgtgtgtgtgtatatatatatatatatatatatatacacacaataagatatttgagtttatttttaatcatagagttgagaaaaccctctacagaaagccaagaagcagtaaggaatatatttaaaatgtgactaagtgaaataaaaggaaaaagtttgaaaatcttctccggcaagaactctttataaaacatttaaaagtaaatatttatatgaaaaaagatattaacatgtatgaaggacattagtctgagtcccttaatttcccaggagttcataaattaatgtttaaaatacaaatatatacaaaagaaaataatggacaaatgaggtacatgttggagaattaaaaataaataccaagtgaaattccaaaatatgcccacttattcccacttaaagatatgcaaagcaaataacaatgataacattttccctctgttataatgccaacaaatcaaaatgttagataatatcctgcattgacggttgagtggaggaaattgtcgtttttgtgtactcttggtacaaggctgatatttggatagaatataccagtttggccatattttccaattgataacagcatctgttctgattgggcagtgcctatatcctagtaattgtaaaatattttaagtgtctctcttttgtgaagagtatgaattggcacaacctttttataatacacttagcattatgtattctcattaaaaatatgcatccacttctgtccaaaaattccactgataaaaacgttattacttctgtaatatgtagaaagtacttatgtattgaatctcatagcaatttttgtaataaggaaattttattaaacatgtgtgaacacatctttctggaggatctcattcccgatgttatcttccatgtatagagagcttccttggaatacagtcttggatactatcagtctgctcacacacttctctccctgggcaacacagagtgatttatctgattggtggctttgggatgaagaagctggcaagatttatcagtcttatcgatcaaccattctcctttgggatcatctctaagaaaagcaaaacactttcaactgctctcaagcatgctatcatgttagtgacgagggctctgcatctatgggacttgtacttagtgaaatctaattctgacacaaagtacttaaaatacaaaagtgttatacacttaagcgaaattctcgagtatcaccttctatccatattatagtcttattcttcatctgcttgttcttttactcttatcagccaattgattttgaaataggatgagaagggtaagatttatggtgcttccaacaaattccataatctataatacaatactagaattaattttcctatttacaaaagtgggtattaatagtacctacttcacattgtgtgctaaacccatgtatacacttacaagatttagttgactccatttgcctctgagttctagctatgtcattaataagatacctgactacacaggtagttgcctcattttctttttctttctttatttctttttgttttttgagatggagtctcattctgttgccaggatggagtgcaatggcacgatctctgctcactgcaacctccacctcctgagttcaagtgatcctcctttctcagcttcccaagtagctggggttacaggtgtgcaccaccatgcccagctaattttttgtatttttagtagagatgggatttcaccatgttggacaggatggtctcgatctcttggctttgtgatccacctgcctcggcctcccgaagtgctgggattacaggcgtgagccaccacgcccagccagttgcctcattttctaaggatgatcaggtgtcccaatttaaccagaacagtcacggattattacagcatccttagtataactattatacttatcataattaacagtaaccctttttaagctcagaggtgcccacatttgaaagtttgattacatggtattctatttaacactgctggctgttttagcgtcccccatggagtaagggctgggctttggcacaacttcttttctgcccatattggcaggagccctggcatttccagccgtcaggtccagcaatatcaaaccacagaaccgcttgtttctgccactactgcccagagcagcattgtaactcaatatagatgagagggaaagttggtgcatgacggaatgaactttgtcagttaaatgaaggggaacagggagaatccagagtgccatatgtacatttcttctctgtaacagctaaggatgaggtgccctagttctttccataaatcctctgcatgtgttcaaataactagccatattttaagaggctgggtgctttagtaaggcacttatttgaatttgcttttttttttcttccctggtgcattcttcttttcccctccttggttgacctgggattgtattcaaagacataaagtatggatttttctcttgctcttttcttttagggaacccaaagtaaaacagtaccaggaatggccctgaaagcaaagcactcacaaagggctttaggactggatagtttacctatctggatgtaacaagaatccccttgctttctataaatgaggcctaaaattgtggcatgctataacataacccattattaaagctttcaactttttaaattgttatgaggtacaggtaaaagacaagttattagatgatcaagtggatgttgcttttgtggatttaaaggttatgaaacgtagatgaattttggtgtgggtgattgttttttatgacattacagatcttgaaaaatcagaaaataatatgctcagggaacttaatcttcaatttaagacatgtcctaaaagtcagagatttttaaaggagtttcaaagagattattgtatccccaaactacgggcaattcggtgttgaaatcaagcccaggatgtagcagaacaactcaggtaaagtgtaatgctttctgcaaaatttaagactgtagtacaaagagcgggagcctgtaagctgggatatgagtggatgagtttgggaatatttaactcccccaatcctcgaaatttcctggcttgcagaagcatcccaatccccctgtcaagaggagaacagcttcccttgtctataagactctgtgaccatcacaaccagagcatttacctcacagggcaatactaattcacctcaatatccacacttactacccttttctgtcttcaggaaaataacaggttcaattctctgcacagccagagcttggcagtacaaagtctgctttggaaagaaatagtttaaggaccaaataattgaagaaagtaagaaaacattttggggaatagttcttgagagtgttagatgatagggacagaaaataaggcagataggggagaattccttgataagctggcactaacttaggacatggtatcaatgttctggtgggaaactctggaattgagcagctggtcatattttgctgctttttgagaccaggtacaaagaattaaccttcatttaatgttgtggagattctaaaacttttatgagcgcagtacatcaggttgagaagagggatcctaacactcagagaaatggcaaccccagaatcgaatgctgaatattcaccacttgaatatgttctctaggagaatacaatgagcagtctcttcactaaagcactatgatctgcgatgaaggcaaagatgctattatctgtgaaaagtgttttcgtgccttctctctcgtagttggcgatgctacgtaggattgggctccttaatattgcttgtacaatgacagaagccaggtggcagcacttgattggcactgacatagtggatgcaattatcttaatgtgaagcgaagtcaaagtatactcagagttcattagtctatagaaatatatggcaaaggctaataaatagatcttgagtgtagtgttctgaaagacaagaaagataactgactagagtttttctctagttgcataatgtaaaaaaatgattacttcaaagagaagattgagctcagtctccactaagggtggtcacagatcctcatacatttttccatacctaggacaatcatagacacagagctcactgattgaaaggagactgaaattattatgaaagggtcgtaaaatgtcatctcaatatacgtggttaatattgttccattccttatccaaaagacctgtgtccatatgccaggttaacagttctctggagaaaaaggagtaaccagatctttttgagcaatgtgaggtacagggctgacacttgctaatgataccaggaatctacagttgtgaactgggtttccctgtactgttaggttaattgaccttgcttacactaaggaattagggttgatactgcacgatggaggaagggtagaaaaaccatcaaagaccttagaggattctaggaggaatgtgaagttgatgtaaccatggcccagcaaataagtgctctgacattaccaggatttctgaaaatttcctaggcaagacgaaggaaaatgttggcccgggtgagggagatctatagtaggtggtgatggtgggagacgatccatattaattactctttcactgagtacagaaacagaagccataactcggttaggcaatctttttgggggactgcaagtggctatttttgaaaggttacacatgggtctttcccccattggaaataggtaagaacatctggatattattagaggatacaagtgtatcagagaggcataagtcatagggtgtatctcacagtgtttgtacttccttcacccaaattcttgatcttggctacctgtggggttgtagcacatgctacttggagagccttgaccaccatggatgtagcctcacctcttaacatcataactcctagggcagtagttgaggttaacgtggctctgttgcacctgctccagtggaatgtgcagcagctcctgtgcccaggaccaatcccaccgaagccgtggagaaatgtgtcccacagcacgcgcacgtctggaggggttgggctgctcaattaggaactgcagagaggtaacagcttttgattgaactttaaccaatggcagacactagtaagaaaggagccgggtgattaatgccttagctaattttcccccaacagacttctctgagccaaactagttccgtgggtatcctctggaagcattaggtatgaccaagcaaattgctttacttccttgtgtaaagcacaagaccgcggtcctaggttatacacaaacgtgtctgcattcctttcttccctggaccattaacacatacatgttataatagaactagatttaagaaataagaattttttagttttaagtgacttaatacatgcaaagctttgagaacaatgcccagtccatataaataatatgcaggcaaccacaacgaagaggtaaaaaatgagcttaatcagcatctaccaaaattcaagttattttattaaatgtaaaaaaggtaagttcctaggtaatggatgcaaaataaagtgcacttacatattatttaaaattcaattcatatatgttatagcgtatagattataactaaaatacccacaaaacaatgaaaggttagataagaactgatcttcagagagagaatataatgctcattctttcttttggcatttattcatttatttatctaccataatagtaagcagacaaaaattaataataagccttaaatatacagtataaaatataccacatttctaaagtaatcgtagattagatggaaggtaaaactttggctcaatttgtttctattgttataacattggcctaaaaatgcataataaatattatttaagtgattcgaaaagtattctaacctgtatacattatgttagtcataacagtaaatattataaggtattgttacattttgaaattagcaaatacatttgaagaatgcataaaggagaagcagacatagattaggcttcttcagaataaaaaaaaaaaagtaactctacagttgaaatagagaagccaagctgaattttgaatggaaatacttgcattgatgaatactgccatggttgtaagagtttcagtgcaataaaccttcaaagttgagaatgggtctgtttttgcaacctcagacatgtttcctagaaatagatgtttggacaaatgtagaaactgatagtaaatgaaatatataaaagtagccaaaagaaaggttaaacagtttagaaaattgtacatatgacatttatactaggaaagaaatatctttataccaaattggtcatcctcataccaaaatggtctccatcaatgaaatggagatttgaagtaaattttaaaataaagtataaaatatcattgatttggtttttactctttctacctaatacattttcaatatgcttacttgcaaatataaaataattaaaagaaaacatttaaaaattatttctcattctgtcgtcttttttttttttttttttttttttttttttttttttttttttttttttgagacagagttttgctcttattgcccaagctggagtgcagtggcaccatctcggctcaccgcaacctctgcttcccaggttcaagtaatgctcctgcctcagcctcccaagtagctgggattacaggcatctgccaacacgcctggctaatttttgtatttttagtagagatggggtttcaccatgttggccagggtagtctcgaactcctgacctcaagtgatcctcctgcctcagcctcacaaagtgctcagattacaggtgtgagccaccgcaccctgccccattctatcatgtcgtaataaatgcttttaccatgacagtattttcatcttctactcaactaaattctcttcattacattacatctttaattatatgatctttttttcactagtgaatgtatggcaaatattttcctattaaaaataatctttgaaaacaatttaaacagttgtacattactctatcatatgtttaaggcatactatacttaatggtttatcaattataaaagtcattactctatgttggttttgagctgtgttaccccaagtaaattcttactacatttcccaccattcttcgtcctgcattgttctggggttggattagccacgagaaaaatgtatgtgagattgttcaacagaagttaagttctgaaggttggagaaggggtcaggtgctgctgcagtttgcacgtatcttcagtaatctgcttctttaccttcttagggtatgagtcagggtggggactgggttctccaggcccatagctacttcttctctcactaaatgctctcctgtaacctctatacatcttgaaccaggtacacgtattgccctatggtgaaatggtcaagcaggtgactgtagattcgagttggatgagatgatatcactgccaaggttatcctcaagggttccactgtatactgagctacccatcatttcatgtccagtttttcttcttaagtgcagatactgatgacacataatgattctagatacaccatcggatgcagagacaacagcgtgcatggtgtggtcgccagctcctgcatggtgcaaggtcaaattcccagaataaatctctgatgccattggcttgggtcttgtgccctgataaaactggtatactttttgtctccagaaaaagaaatctttgtttttatcaacaatgatgtcacaacaatgatgatgtctgtaggattcattccttataataaaataagagtgtcgaagttaggaaatcttaataattttgaaaagatcataatgtgtcaaacaatataaaatatgactatcagtgtttgaaatattaaaattcctagattcactgaatccctatcagagtctcactgaatattacagttttattttgcttaaaaagtaatttttttaaatttaaaccggaataccattttaattaaatttgcaacttataatgatacatttttaaaaaatatatttctaccacaaactgcttttaaaatttctttattctctaaaattttaaatcttctacaacagtgttgtaaagagacataattgacatggaaaaatggaagaaattttttaaaatattgagcctaatttatataatatgtataataaattagacaaggcaaatcaactagcaagtgatggattattttaaagtattaagcatctataataataataatgagttattaacttaccagtcatatactgcaattgacttcagatgaactaggaaattgaagaaaataaactctttcaaataatatattaaaattttgctttcaactaacaaactcttttaatatttcccattgaaaatatttttcaccagtggccttttatccatagcatgtttagaacaattattttcttctttactgctgcttttataggccccatttttttgcatagctgcttttcacagtcaaccttgaaatatttgagaatttccctagtttacagtttctaggttgtctgtgtatatagagattttgctctcctcagtgtcatttaccattctaaaaattttcaaccagagtgatgattgatatctaagtaattttagacaaatatttggtaggcatgcaaacattcatcatattttatggttcttaaatgaaagttcatgaatatatttttgctattcgtgaagtgtgtttgagaatatttgtttttatttcatccttgctattctaaaacaataatcacatttgaaataatctagatgactacattaaaacagtgtattactacatgatttcagagcctatattttcacctatcactatattccataaaaatctatttttcaattgatgtttcttatttgtagtagtaattgcagttgaaaaagatttctgtagattcaggctgtgattatttaaggaatttaatacactgacatttctatttgatatcaggaaaataatctggtaatttatcattttaattttaatggtttatgggaaaatagagtacgcttaatatgtaaataatattttaattaaatgtagcgatctaatatcatcaaacactgcataaaaaaggttttataatagttttaccatcatagaaataattttcaatattatagttgtttcttgagtagattttatgttctccctgtcattagaaatgctttattaatttagagaagagtttttaaataagcaatattttgtttttacttttgcatttggagacattccactaagttaattgtttcatcaattaatagtctagtgcttacaagtttctcatataaaggaaaaagtgcttataatgacaatgataattattaaattgatgattctttactctcaaaagcaaaagtttgatttgacaaataaaatacgtagaaaaaaatacaattttagtattaaatacaacattggtaatgttttttcaaacactaaacaatgtaacttacgttgtcataataatcataataatagtacttatttttactcattttgtatttttaaaatagtttgcagggttttttaaagatttaaaatatacaatagcaaaaagcctaaaggaatctaatgtacatttatgtgtaatgtagaaaaaaaattggaattctatccactaattataaatgtctgttctggtttttgaaaagctttttctaaattattcaaatgtgaaaatctaattatatgttgcagaactagagtctcatatttctgatgctagttcctttcaaagtgaaaagtatgcatttccctagacatctttttataatttccagcattttttgtaacaatttataaaatattacaacctttatggtacatcatttccaattctctttctcgtccttatttgctactgaattcatatttaggaatctaaggatatttatttacatgtcaatatacatattattcgtcactttttaaaatatcttgattatacagtcactgacagacgtttaaattttcattgaagaaatcttaaaatattgaattcgttttgttccctagagataaaaaaatcatttccttatataagtttaaaaaggttttataaattcaaaattaatactgacagtaaagtagtttaaattttccaaaagtatttccaatgaaacacgcagttttggaagttaataataatgatgataataggtgctttctatgactcagctgagttatatgcagtgagagatgttataaaatttagtagaacaggcatttagtagaacactgtcttgtcatctaatcatatggagcatagaggaaatttccactgcactgtaagaaatgcgaaatttatgtgcatttgcccgatagcatcctctcaagaattaaacacacatgccccttctggcctattaaacatattttctatattaactttttcctttcctatttattattataaactataagtgatttttggttggtttagtttttgttttgtttgttatgcaaaagagaagcagctccttagagctgtcaaaatgtttccttgccaggattattttgaaaagtgatgtcatatgggtacgaaaatcgtatttgaaaaacatatgtcaattaaaatcactatttctctccaaaattaataacagtctatattcccaaaattgactagcggaatgttaagtggtgtgtagttcaaaataagagcccacaaactgaagtcagacaattatcattcattaggaatgtctcacactgaaacagatgtattatagaagcctgagttctcaaaattttatgttaagtatttatttacttttcgtattctggccaatctttgtttttcttttttgtttgtttgtttttgttttgttttgttttgtttttgtatttttagtagagacggggtttcaccgtgttagccaggatggtctggatctcctgacctcgtgatccgcccacctcggcctcccaaagtgctgggaccacaggcgtgagccaccgcgcttggcctattctggccaatcttttaaagaaaattgtacatctaccacattagtctgagacaactaaaaaagaagagcaatactggatgctataagggtgaacatagatgtcatagtcatttcattcttactattccacgatatatgttctactaaaattctttttcaaaatatgtattcttattatgcatcactgatcataaaatttatacattatattaactttggaaaaattcattgtagtgattgtatttgatagtattctaattttctgttatttcctactttgaattttcccaatacatctttatgtagaaatgagaagacattatatttttttatgtccaccacatgcagcagcagggaatgtggggctcagacttgttgcattgaaagcttgagtagaactgacaattcagagagaaataatccagggaatagctaaattacataccaagtaaatgcaacgtaataaattagacagtttaagtctggtttgatttttccccagtttaaaattgaggaaaagagagtgagtctgattctgtccccatttaaggtaaaatctctaactgcattttatttgaagggtacacagagggtttggtagtaataaaggtaaaagcaacattactcaagtccaatcatcatttttgtttaaactttgaacatagaaacttacgtttgtatcctgtttcatgggaaaataggcttgctttacttataaagagtatattgaaatttaatctcatcatccatatgtgtaacaaaccataaaaatcaaacgaaggattatttttattaaactttgccgaattattcaaattttctgaattctaataacatttgcatgatagaacctatgaatactaataatcctgttgaaagcctgtttattagtattgattttgttcgttcaaaactggttactctatattaaatttctactttggagtactatgtaaaattctctttctagaaaaagtgattttgtgacatttttgtttgtgttatttgattagcccttagattcttctaagcaaatagacaaacattttataaagaaaagaagtctttacccaatgattgctcagagtagctacttcttagttagtatgaaataaaaaagtatggtaactcttagaagcaaatttaggagtaagtctttgtgactttaagtaattaagtaatgatatttctttatgattttgggcttaggaaatgatttcttagctattaagtgaaatgttaataatagcattatttatcatagtcaaaaagtggaaataatataaatgtcaatcaactatgatgtatctatacaatggaatattatttagcagtaaaaacaatgaagtactgatacagagacgaatctcaaaaaacagtaagctaagtaaaagaagacaatcacaaaataccatatattgtatgattccatttatttgaaatgtccaggatggtcaaatctgtagataaagtagattaccagcttactatctttggtgagaaggaatggggagtaactgctaatggatttagggtttcttttggggggatgactttctaaaattagattgatgatgattacacaacgcatgaatatgctaaaactgttgaattgttcactttaatttggtgagttttgtggcatgtgaattatatttcaataaagctgtttttaaaacggtacagaaaaacagggctgtaaaacctggatgaaagaaaagttaaaatagttcaaaataaagagaagtacagtgttcttgatagatagctgaaagctgcaaagcagaatcaaggtggtgcttcaagaacaaagctatgtgtatcttttgggtgtggccgcaccatttggatcactgaggggcaaggtaggagcatatgatgtgttgttgcatagaggctaagttagaagggaggtcttcctataaaatggaggcatctagaagacaacagcttccgcagatcgaggcagggtggagagactgtctcactttaggaaatggtggcctgtctccttcttcctgctgtagttctgaatagggcaggaaaaaaaatcttccctgcaagtaactaatcataaatttgagctcatgttgacctggagttcaaattcacactgttttcactaaaataccttttctcacactcttcgcattctctcctcctatgcttggaaaacaatcacagtaattagtttttaaaaccaatgtttaaaaatgtgtttaaaattttgccctttgggtcctgtcccctctgcaactatcagaatgaaaattatttatgaaaaaacagacttaagataataccacaaatagaattaccatacaaacaggacttagtaaaaatactaacaaacgggaaaaacagagctcaattaggaagagtggctgggcacagtggctcacgcctataatcccagcattttgggaggctggagatgggaggattgcttgagatgggagttcgaggccatcctggacaagatgatgagaaccttcctctatagaaaatttaaaaattagctgggggccgggcgtggtggctcacgcctgtaatcccagcactttgggaagccgaggtgggtggatcacttgaggtcaggagttcgaaaccagcctggccaacatggtgaaaccctgtctctactagaaattaaaaaaaattagctggtgtggtggtgggcaccggtaatctcagctactcaggaggctgaggcaggagaatcacttgaacctgggaggcagaggttgcagtcagctgacactgcaccactgcactccaacctgggtgaaagaaacagactctatctcaaaaaaaagaaaagaaaaagaaaaacaaaattagctgggtgtggtggctcacacctgtagttccagctactcaggaggctgaagtgggaggactgcttcagcccagagatcaaggtggcagtgagcaccatgatcatgccatggcacttcaacgtgggcaacaaagtgagacctccttctctaaagaaaaaaaagaagaagaagaagaagagtcagtggaaagaaaagaaagaaaaacataaacttcagaatgaagcctgtagaaaatgaagattttgaacttatcaggaaagtaaatataacattagtttcaaaaaaattaatgtagatgaaaagtataatgaccaaagatgagacaaatatttaccaaattgaaataaagatgaaataattaaaataaaaaattcaatggagagttttcacattgcattggtacctatcaatcatataaatagttggaatcattttatgccagatattacgccaggtgttttatgtgctttttgtcatttcctactttgaaataactctacaaggtttgtgctattattatccccatttcacagataaggaagctgagagggaaaaaagggggatgaggtgaactaacttatctacagtcacatagctagtaagccaggaattgaacaaatgaattgtgactcctgagtttgcacttttattcattttactttactgtttggcaaaagataatacaaatgaacaaataagtggatgttataaagtatgaaattttaacttgttgacataggaagcaacagagagagataaaaactttagaaaaatagttatatttagaaatataagacataccaatttagaaattgtaggtgatcaaaatttataacaatgtgtaattatataattgtagatatagttgcaatataaatattacaagtgttatttttcatataaaaaagtcattcttatcccttatcctatattttctgcatgactctaaagcacttgagattgtatatactttctgtttatttgtttattatctctctagtttcactagtaaattccttaaaaacagatttcccaaagtgtataacatggaatattagccctacaagattttgtataaaacaaaaaaaaattttcattgaataagaagtttggaaaatactgcatcacagccacaaaattattatcttgctctcaaacaaaacaaaacaaaagaaagaaaaatcaggccccgaaacaattgatatcagaaagaactagtactcatcagaatctaccttctgaaaagtttttcaaacagatcagcaagtatgtaatgatttgaataaccaaatagggaataggaatatacaccaaaaaaagccaaagctttggatagataagaacgactgttactcaataagttataacaagagcatgttagtgatacgtatttgtggaatccctgtaaacagacccaggtagcagaggcacataatcttacatagttcagttctcttgttttatatgccaataacagtctctaacctttcctttaaggtagctctactaccaaaaatatgcagtgtaatgaaaaatattaagaaaattgttttataaaaaagtaatggagaggccatagaacaaaaagaaagataatcagaagagaaagttagttacctttaagatagttctgaaaaaaaaaaatacaccaaatgccagagacatatacgagaagatatatagccgggggcagggtggggggtgggtggcagttggggaagaaacataagaacagaatgagaaggtatgtcaccatatatctattcatattgctagaatattgagaatctggacagataatattcaagaatataatgccagaaagtttttcacattttgtaaaagacatgaaacatcagatgtaagaatacaacaatttgtaaatagacacaaataaataaagctaaataagttgatatgaggtaaaaatttgttatagtaaaaattcagaatgccacagtaaaagaaaatatattaaagcaaccagtgaatataacaaagaaagaaatgacaattaaattgaaaggtacattctcaatagcaattccagaagctgaagatagcatattttcaaaaatgtaactgaaaagtggaatggtatcataagaaatgaaataactccaaatccaaaattctatagtctaaaatatctttcaagaattaggacaaaatacattttcagataaacagagaattgaagaggaagaaaaattatcacaggaaagcttgagatgcaaaaataaatgattcccaaagaaatggtgaaatttaacagcaaaactaaacaaacatagaagacataaaaagaggaataaagtcaatacgattctgcatctatatgtatcaatagcgtttggttggaagaagctgttttctaaattacctttacttaatttttcttagtttttagttttatgtaaaagactgtattagtcaacttttggtattgttaaagtatacataagcttaaattgcttaggttaactttagaagaatattaatagaaattataactgcaagttaggacagacggaaactgtttaaatagatcaatgaatacaataattaaggataaaaaagaaaataaatatgacaaattgaaataattattaagatagtaaaagtttttgaaagcatatcagtcattaaaatcaatataaatgggtttacatatccagttagcaaaaaataattgtatgtatctagaattttttttaacttttatgttaagttcagggtacaagtgaaggtttatgacacaggtaaacttgtgtcgtgggggtttgttgtacagattatttcatcacccaggtattaagcctagtacccattagttgttttaccttatcctcttcctccttccagcctccaccctccgaaaggccccagtgtgtgttgttcccctctgtgtgtccacatgttctcatcatttagctcccacttataagtgagaacattgagtatttggttttctgctcctgtgttagtttgctaaagataatggcctccagatccatgtctctgcaaaggacatgatctcattttttatgactgcatagtattccctggtgtatatgtaccacattttctttatcctgtctatcaccggtggacatttatgttgattcgatgtctttgctattgtgaatagtgcagcaatgaacatacgcatgcatatgctttttacaaaccccaaattccagaaacataagattaaaaacatttcaaagtaaaagggtgttgttttaaaataaagtagaggtcagaagaaatctattgcaatgggcaattcttctcagtagtcctaggaatgaaatagacggcaactaaatatatttattaattaccacaattagaaaaaaatatagacgtataatccaaaaacttgactaacattttcataattgaaaatcagtttttcatcttgttttcaggcataatttaatttacattctggaaaacttttgacggaaagaatattgggtctcttttcaaaaggaaactgaaacactgccacacatatatgtgtaaatcctcctcggcaaacagccaatgcgctctgcattgatttaccaagatgcgtgtgcatgggagtaggaaaatttgcaaacattttagtaattatgagacatgaccttagttctgatccattttcaactagatagacaagaggattatggagttcaggtgacataatggaattttgtctcaaacaagcctcacaatttttcaatgtgtcttatctcaagagtctggctatttcttcagtttctgaatgcattttaagaatagacagccttttttagattctccatattggctcagtaacctatggactatggctattattgcaggaaaagctaaatagaagccttggtaatttcatctacacaccaaaatattaaactaaatgtaacattgattttgtgagggagttgtagaacagtgaagtcaccaaatgcttatatatatatagagagagagctggtggtttctatcacatcgtaattaactctcttgtctggtctgtacaaaagccaaataaattgagaataatgactggggtttagtatgactaaatcatatgggattgagattgaagctgttccagctgtgacatccttgctggataatgattatcagcacagctcagcacctgacaagcagctattgatcttccatataccttcttaaaaaatcacacaaattactaaggaaagtgcaaaaactatatatgcatttacctgacagtaacagcagtacaccttatcaatcttacctcatatctaagtaaattatcctgttctctctcataatataatacaccatatgattctgtttggacctatggatcatgcagcatagagaactcaagatatcacaggcatttatttactagattacattttttaaaaaatataaaattttaagaaacatagtaatatttctaagttgtggcttgtggcatatcaggaagtcccatgtaatattaaaaataggttattctaccttgccttggacaccacaagaagagaaggcacgaagttcttttgggttttttaggttatactttgtatgttactctgctgcatatccacaggaacacatgaggctgcttgttttttgagggacttggaaaaaaaaatgctgcaggagtttaggttgtggctgaagtcatttcatcaattagtctttatgatgcagcagaaacaattttgcttgaaatatctatggatattaagtacattgtatggcaaacctgggaacttctaataggaaaatctgagtgaagacatctatgatgttggagcagttaccaccaacctcactgatcaatgttatcctttaaaaaagatcagtgttttatatatcatagttggagataaatgtataaatcataagaaaattacacaatacagtttcacaaataaagcctcttttgctgaaaatcgtttatgaagtttatcctttttgtcaaatttttcttagtctgctcgttgcccacgatcaccctgtatggatatactacaatgtttgcatccaccgtatattgagaagattgccgttcctacaaacaatactggtatgaatatcctcacacatgatttggttaacatatgctttcgtttcttttgagtatttcttttgatataatcaaataagaaaagactgtatgtcattaagacagtgatattacagcttgtgataacatggacttttcagtagcagcttttatggaatatgaataagcttaagggataggccattaaaatatggtagttaccataagataatgtcacccttgaagagaaactatgtgccagatacagtcacatgccttcaaacacccaggagtgttgtcacctgaaaattatacctgctgctttttcaacatggagagtgtaaatttcttgtatttaagtacagtcatactcattttaggtatatttctctgatcataagaagacactgattaataataagatgtttacaccattcaaggtatagtaatattgcatagctcattataatgtgagggaaaaattattttattctaataaaaaacaagaaacaaaccctcatctcttcattagaaaacatattgccgggctcggtggctcacgcctgtaatcccagcacttcgggaggccaaggcgagtcaggagattgagaccatcctggctaacagggtgaaaccccgtctctactaaaaatacaaaaaaaaaaaaaaaaaaaaaaaattaactgggcgtggtggcacgtgcctgtagtcccagctactcgggaggctgaggcaggagaatggcgtgaacccagaaggcggagcttgcagcgagctgagatcgcgccactgcactccagcctgggcgacagagcaagactccatctcaataaataaataaataaataaataaaaaataacatgttaatgaaaatatgtgaactgaccttgagttacatatttctagcaatcataaaaatgtaactgcttatgaaaatgaattcgttattataatcactgatcagctttctaaaattttgtctcattaaaaaagggtaatcacgtccttaattataatgtttttatttcatccatactctttaaaaagataggtataagcaaacataattaaagaaaagtgaatttaactgtggtgttttacatcataaacttccagctaatatttcattaattggttaataatttaacgacagaaaatatttatatgttattataataggataatatagaaaatatattctttttataaagcaaatcatttaagaccctttcatgattgttctgaacaattttaagataaaataattatctataaattaatttaatattagggtgatgggcattctttcacacaagctactggattctaagaaggaaaaattgtttttctttcttcctcccaaacctctcaatactctagatgcatttgagtattttatcttacaatacattctatttgtttttacgttttcaagcagagatgctacaatttaaattgccaaaatagtaagaacctttaaacacagccagtcagttgtagaactgatacagaatatggtacacgctattatttgtctaaagggctttccaatggaattcactgcctccattaggagaaacacaggagatgtgaaagaaaaatgttgacactctaatcaaatgccttacccaagtaagaattttctattagtttccaatcttatctcaaccaaccattaaacactttcaatttcaacaacaccccctactgttacagcttgtattgttgaatggaaaattgttctgtttattttgaaaactgctctaagtttttactgaaggttcaacttcaacttacagcaaaagtaatgatacaagtttaccaacaacttgaaatacaatgggaacaaagttttcaattttatttctttataagaaatcccaagccatcggttcactatattgaaagaaaacataagcaagaattacaacagacatcatcagagccaacaagaatctgaatagatattttaaattattatctctttctaattttttttattattattatactttaagttttagggtacatgtgcacaatgtgcaggtttgttacatatgtatacatgtgacatgttggtgtgctgcacccattaactcgtcatttagcattaggtttatctcctaatgctatccctccccgctcccccccaccccacaacagtccccagagtgtgatgttcaaaggagcatttaaatgatggtttattttctttcatttttcagaaagagatgagtttattaagctacctaattaatgtttattttcaacatttacttcagtataagatgttgggcatattgttctctgtagtgagtgtgggtgtatgtgtatgtgtatgtataagttttaagaaaacttaataacatgttctaaaccattaacattagtcttcccatagagcaacagctgtgctgtggcccttgatgccttgcaagtaaccatataggatccacaggcaaggcttaatgacagttgacctaagttactgcagaatgtcctgtgagcgaagtgagtcagcatgaaaggcttatgttagcaggtcaatttctcatttacttccgtatttattatggaggctgtcaagagagtttctcatcagtttccggcttctgatgaagtctgaggttttgtgcttttccttcttaaggtacatctatagactttcaaactgcatagctgcagcgtgaaatcagctctatagcaatagcttggccactattgtctatcatatgaagctttttgttctattgtcattgtgtaggataagggcatcgggagatgacatctttgctattcttgctttcactgtctatgtaagtaataaattatctgcatttgaaaggagtttgttgcttcttcaccagcccaatgtgtcagcgttagttgacactgtctttccaagaaatatcatatggagagtgaatttacaatactgcttcataaagtggcctaaaaaatacaaaacagaaacaaaacaaacaaacaaaaaaaaagagtgttggttatcaggtcatgtagtgaagacattttaaatcaatataataggggaaaaaaatccaatatgagaacttaaacatgtagaatttgaaagtgtgtggtttcttcaatattgccatgatttttccaagattcattagggaaactctttcactgtagattcgttaaatcaaaataaatagtcctgtcttcaaagagtttagaatgtttatgaaagaagagatacattttgtagtttttacatcaaatagaaaaaaactgtatttacacattccatataacactccaagaacgctgagcaaactgaataccaaattttgattgtcagactatttcaagattattttcattaaaattaggattgtaggcctgacacaatgtctcacccctataatcccagcactttggaaggacaaggcagcagatttgcttgagaccaggaggtcaagatcagcctgggcaacaaagtgagaccccatttctagaaaacataaaaattagctagacatggtggtgcatgcctcaggagactgaggtagaaggatcccttgagctccagagactgaggctgcagtaagtcttgattgtaccactgcactccagcctgggtgacagagcaagaccctgtctctaaaaacaatgacagaattttaaaacattagtattgtagcaaaaaaaaaaatcattactattcatcttcctttccatgtattaatgatacaactattaaaacaaattagggaaaatgaagcaaggcaaaaacaacttcaaaactctttatggtgcagaacatcatgtaagagtttattgcataatcattagctaagggttcactggtggaatacaaactacatacacaaaatattaagttaatgccacttcattttaaatttttgacaagacataattttttcagagttatgtctaaagatttgcctcatttaaatttgaactaaataaccataagttaaattttacacgagtgttcaacattacttttaaagcccattgttacagttcctcattttgtagctgcttgaatgaattccagcaaagctatgtgagtgcaagtcattatgtgaacaatttctttaagacagagtctgaaacaatcaatgcagtaactagaacaagtaacatggagttttgccatccatgcttgcataaacatttcagtgatgtcactagatataatcctacaaattataatgctactaagttttgcattaattgctgttcaatatgtttgtattagcgtattgtatagttttatgggttaacccaaatgctttaaaagtgatagtaaatgcttcccgagaaataacgtgctcacttgaaggaaggaaatggttcctcaaaaagcatcaatgacatattgatcatgtaaaaattattttatataaaaactttttattccaaaattggtccaacatatgacaggaattctttaaataatatatttacataacaaatataatgactaattaaaattctctggcaaggaataagtttcataatccctctacctgatacaggtactcattggaaggtaatgatgtacttttaaactgaatgtttttaggattacagttataataaacacacacaatagtactgcctttttttcatgcataacttaacttattttcatatctcaacactataccagtaattttataaaataaaaaaactttctgttcaaaaataatgctaaatgcttgaatttatttttcaagatgatcctccaaatgtgtgtgtgtgttattgtaatgagaaaaagtaattatattctatatcatttctgcaattcgcttctttcacttaattgaatactcccggaaaattgccttgaatctttaaaaaaaagtatatgagaaatacataaaaaagaattacataaaaattgtgagaaatacataaagtataagaactatataattcataaataagtaaaatatcagtttagaagaagacatatcttgaaatttttttcaagattttagtaaacgtcacgctcttttcacctaatgatattctaataattataattcaaatattgttaatttcaaaaaaaaaattaccaaatatatttggtacaatacaaaaatgaaattatcacttcttttgctttctaaaataatttctttaaaaataactgtagtccaacattggtcataaaataatgcaaaaaaataaagaattagaaaatcatatagcagtatattaaaacataactcatcaagagaaagagggtactgttatgggaagacaagaaagatgtatttgatagatttgtcttttgggtctcatactagagttatgggtggatttatataccacaaatacagtaatagagtattctgggttcttccatgtacttaattttactaatgggttttaaacctcaaaaagttttgttttgcacattagcattttttttccttcagattggataactctttagtatttcttgagagatggatctagtggtggtaaattctctaagcttaaacttgtctgggaaagattttatttctccttcaaatttgaatgacagttttgttggatacaatattcctgggttgcagtatttttcttagagccttttgaaaattttattccactccctcctgatatgcatagtttccattgtgaagtctgtcgtccaatgaataagagttcctgtatatgttattttttcctatctttcactgctttgctgcttttaggatcttctctttgtccttggcctttgagagtttgataattaagtgccagggggtagtcatatttggcttgagtctgcttggtattccaaaaccttccagtatcagaatatttatgtctttctcaagttttgaaagtcttctgttatgatttccttgaatgggctttctactctttgttcttgctcaactccctcttgaacacccataattcttagatttggttttttgaaataattttccatatcccatgggtggtcttcattcttttttgttctttttttttttttctcctctgactgtgtattttcaagcaactggtcttcaagcccactgattctttcctctgcttgagtcattctgctcttaagagcatctaaagagtttttcagttcagcaaatatatttctcagttccctgacttctgtttgattgctgcttattatttcaatctttttgctgaatttctctgatatatttctgaattgcttttctgtgttattttagaagtcactgagtttccttaaaactgctgttttgcattgttggtcagagctcacaaatcaccacatcataagagtcagtcactgcatttttgttttgttctttggagagattatggttcccttttcttttgttgtttactgtgggtatatgtctatgtctttgcattgaaaaattagttatttattggttttctctgtccagcttgttgtggttattgttgaatatatttgtttagggaattttcagtgctaagtcactgcctgccttttggctctaggtggcaccttaaacctaggcttattactggcagcaaattcatatgggtctgcagcaacctcagttcttgcctcctcaggagaaataattcaactgaggggcataaggcagaagaggagactgaggcaagttttagagactgaggcaagttttagagcaggagtaaaaggaaggaaagcacagttagaggagggccaagctggtgaattgagagatcaaatatcctgtttgaccttggacttgggattttatatgttggcatactttcagggtcttgggtcccttctccctgattctttctttggggtgggttgtccacatgtgcagtggcctgctagcacttgggaggggagcatgcagagtgtgtatactggagtggtacacatgttcacttgaggtattctttccttaccagttaaatgtccctggaaggtcatatatcaattaaacttcaccacttcacctcttaatgcacatacttgagatgacttgcccaactcctgagatattattgggaagctgtgcatcaccagtttcaggttttttctaccgattaggagactgtctttacctggtgctgtgaccagttactattttagagaaacagttaacaactccctgaccatcacctgatgattgcctgacattcctggagaggggcagggagccctccctagcactgttcttgcttaactaggtacctactgtaacaggttcacttcagctctagtaaatggtcagagtgcccctgttccaaatggcagtggctctgtaaccacctaattgcttcattttgcctgctgcccagacaatgctgatttatcaagacggggatattgcaatagagaaacagtttaatatacatagagctggctaaacaggagactggggttttattattactcaaataagcctccccagatattcagaggctaggatttttcaaggatagtctgggggactaagagctaagggaatgggtgctgctgcttggtaaggaatgcaatcagaggtgtttaataaatggtcctagtttgctgagtctgcttctgggttgggaccactggaccaattgagctaagagtcacgggtctgggtgggaccacccagtcatcatcaggtcattagaattgcaaatgcctgaaagggcatttcaaaaagtcatagtttctataattgttgggtaattgcaaatcttgtgacctctaaaataatggctggcaattatttaactatatctacatcttagcagaattcaggccactttcatcctcctaacctggtggcctttcattagttttacaaaggcagggtagtttttaggaagggcagatagtttatcattacacttttatatagtttatcattttgaactatttactaaatttctcccaaaattggcttcacccatgcccaggaatgaccaagggcagtttggaagtaaaaggcaagatggggctagtgaaatcatttctctttccctgccataactctctcactttaatagtttttgcaaggacggtttcagtcctaaaaagattaactcccagtgtaggaaggctcactaagagtttttgcccagggtacatggtgaacatacctcctgctgccactctgatttgatgtctcctttggctgagttacagaatagagtttccaagctgagtatggtagttccacttgctccatttgtctctccctgtcctcaggaatatttctccctgcaggcagtcttgattctacctatgagttaaggcaaggacaggtcttctgacagggaacccaagaaggtagagaaacacatggttgctgcttgagcagaatataaggggagaggcattatagaattggaagtctggttcccctaccatctgcttccacatctttgtggccccaggaattgtttcatcttcatacttgagctctggactgttgctgaagatctccatgttgtatatttatttttgtttcttgtgtgagtcagcagagagagaatccagcttgcctttatgctgccattacgctgccaactacctcaggaagatgtattttttatgcacacatactctggttaaagcaaactctgtagaatgaaaattgatgggtgcatctttatttggaatagacataccacaccacacatacacacacacacacacacacacacacacacacacacacacacagacacacacatttacctttagtatgtatttgtgttggttgtcagccaggacccttacctatgttcagttgaaaccaactctaacatatttaaaaagggaatttttcagaaagatattttatagcccaaagattaacaacgaacctgaaatactagctttggaaagctgacttgaaccaaagaaagcttggaaatcataccctgcaataaaaacaacttggtcaggataccgcctctgataaaaataatacagctgggctgactgcggtggctcatgcctgtaatcctagcactttgagaggcctaggctagaggattgcttgagcccaggagttcaagaccagcctgggcaacatagtgagactctgtctctacaaaaaaaaaaaaaaaaaaaaaattaactgggcatagtggtacatgcctgtagtctcagctatgcaggaagctgaggtgggaggatagcttgagcacaggaggttgaggctgcagtgagctttcttgatgccattgcactccagcctgtgcaacagagcaagactctgtctcaaaactacaacaacaataacaaaaacaataaaaacatagctgctcctaggtttctcaatgtttcattgtaatttctaaactttttgtgttgataataaaatcccagaaaaaaatgagtccaattcactcaaattatgaaattatgtcatataacttttcaatggataatggatactggatgcagaatagtgtacatacttagagtgtgtgtgtgtgtgtgtgtgtgtgtgtgtgtgtgtttatacttagcttctgcagtaaagttggagaccaagtctcagtaaatatatattacacatgaatgagattttcactcaattataatttctaacttgttataattatttaagatatcaattatttactatttattttataataagcactttgctcagttagttgatccagttagtttcgttagtttctggttgactcctgaattttttcagacattcattatatcgcctgaacataatgataaacttggtctcatcttttaaattatattcacatattggtattctttattattttctctttccatgaattaacccctctggaatgaaattgcacaattggtgtgtgatatttcatcaccttgtagaggattcatcaactttctcatggcctgcctgaagtgagattgttagttgagtttgcagaatatcttttatatttcagtcaaaagcctactctgttctctcagagataggaattatgagtgaaatattgatgccatcttcattctgattccttataacttagatcttttcttgactcaatgcctatttgttattgtaaccaaacacaagtccgactgcttttcacacagaagccaaacacaagaattgagatgaggtgaaaggaaagcagttttattaatcaaattctagcaaccgggaaatggtcccgctcatgcctccaaaaggctcatgccaccaatttcttatttgaggctgggtaagagttttaagaagggaaacttggtatgagaaacatgtgggaatgaggcagggtagaaggcctatgtgtcttgttccaatggctatcttgcgctattatctaccttgaacacgggttaaaggcatttcagcaatggccaggttgcagtttaactaccttggggtaatctttagatggggaaaattccacagttgggtctctgcacctgcgtcattttaagtttagcccccgaagttttaagcaagaacataattagataaactagcacaggtcaaggagtgtgtctggttgggaaggagggaaacaacaagattcaaagtatatttcaagactaagactagacagaacaaaaaagttttaaaatgcactttgaagcattgtaaagcactacatgctctcaggtattgtagaaaaaaactaaaattgaatggaagaatgaatgttaaatctcatacaggaaacactgcatcactagactgaagcaatggaaaacgttttataaattattaacttaacatggggcatcagttatgtattcccaatgtcacacatttaatatagagaataagaggctcacatcaccattgcaagtctagggcagtgaagttcagggagctgtatacagggatctctagtgcaagcaatcctcaccatctcacaccaaaggcattgaacctcagtgaaggcatcttcctccaactacctcagtttgcaagaaaaagtggatggttctcaaaggttgtcttggaaaatacctcttacttctcacatctagccatcatcctgcaaatatgtctaaaaataaatcatcatgactgcttttttaccttctaattttgaaagtgcctttggaatctaggaattgaagctgttaatgtcttctctataaggcaaaagaaactttagaatacatttttttgagtatttaaaaaaatgttcattcagtataacagtcctacgaataagaaactgattactttgagataacggaggcatggaacaattccaaacaagacaatttggctccaaactctatgcccttccagtgctaagtatttacatagctaagcatttacatcacatacatatgtatttgttatcaacattccagtcaaaatatacccgatcaactaaacatacctaattagctgcattttcaaggtatagatttatttcattttattgggcaagcctgaccatatgacaagcagaggtaaaattggtagcattacaatcttcttcctcagtctttgacctactgtactaaagctaaatttaaaagattccacagtgttatacggttagctcaagcaagctcattggctatgaaggtaaatgttggtgttaatcaattggtaagatttattcaaaagtactctaatatatgcattacctaatacctttaaatattagcctaattgatcaatgcatagtcacgtaaaaagatagatagcagtttgacataaaggcaggttctatgggcaacagaagaaacaaatgtctatacctgcaagactagaataataaaagaagagacatttgaatggaacattgaggaacaagattttaagacaaattcctcctgaatagagagagaattctgacatatttctagagatgttggtattaagacaaaccaaaccaagaatttagtgtaaataattaggacatttgagtgatggggtaatatttaattcattttaacatttcatattctgttcagagatttaagtagtataacaatttcatttacctaaaagtacactgttgccaaaatgtctttctaacctcgtggggtttgaccagccagcttataagagcaatttgaaaatcatgccactgattaactaagcttcctggaaatttcaaaatatgttaagagtcagctgatttgtcagttccatacggttactctcagaatgagatcacagggttattttattgtgaagatggagagcagtaaggagttcacagtgtatttaactcacatcagttattcctgttacacttctcatttacattgataaaatgtaagttttgaaaacattaaatatttatttttcattagtttgtgtctcagatatgttgtaaagatcaatactgtatattttaatacatgtcaatgtaactaagttgcagaaatatttaaaactgatttcggatgaagtcagtctgtctgctttgcatagataaaaattgtgtctaaaattacattactttgtagctctgggtttcacaacaaattaagtatgatcaatcctttcattgtgagacttttacaaaatatatttctataccttctatcctaaacactagggagccacagatttggggacacctaagaagcaccctttctatttttctctctcccaatcctgttcagatcctataataaggttgcaaaaatacaagaaaaatgtttgggaataatggttccagagcaaaacggccctggctgtattccgtgggacactcctgtacagagtgatactaatacatatttcaggaaaagcaagccctggggtcaaaaatgtgagtaattttgcatattactctttcttggaaattcacaattcatatatgcccagtaaatgttctgagaaatcttgattgagaacaattgtttaaagtttatttaattttcataacacaaacttgattagcaaagcctcttgttgtattgtactatatatatcatctctattttatccaaggataatatttccttgaatatatttcttgaagtcttaataagacttgcgtagacaaatagctactgactagataaacagattgggctggttagaaggaaattctctttatcattaaatacctagacacagtggcttctatggtctgcatgagcaaattactgggttgggtatatgtatctatttattatttagataattagctaattaattaattgttaatagaatcaatagtgcattttgataccttcactggtgttgacaagttttaagcataagttttctggaaaatgttttgccactataaggagagagtgtgactgaaagtaatcaacacataaaggcgaaatgctgggagtcagaaaggaatatcccagaaacctatttgaaattgaaggtgcctgaatttcaggtatacctgaagctaggtcttacctagacttttctaaacatcactgttaaatctgtcagtcccctctgttggtttttgtttttgtgttttgctttagttagcttgagttgaggttttgtcacctaggcaatcaaagtaactttgaaaaacacaacagagaaatgttattaagtaaccttttttttaaattccatgacttcccattactcaaaaaaatgtttatttttgagaacgtttgaatatttatgtacacatacacaaacgtatataggattatacacacacacacacacacacacacaccccacacacatgtattttttctggaagattgtcttgatggtatgttttctaggccttagctattgcagtgttatgattgaatgacagctggtggcctttgtttttgttgttctttttttgaattacagtattttctcttctgtattcaacagagactacttcattatctcctcaaatttcatatcacagttaaatctgaggctagactgtttcatttatcttgtaagtaattttttattaataaacctttagaagtatttctttgtctcttcaatttgaaatttatcaagtttacttattgctatgtagattagatacattatgttatctcattattcaccacatttaacttttcagttatgcaaatgataagatacagaaaaaatattattgagtggatgggatttaagggagtaaggatcacattaaatcttgcttaaataattatctaaaagtttgataattgtaagtagtcaataatattggattttgattagatgtaagtgcaagtccagttatgagtatctataaaatggcataaactttgttataataaagagcacttaaccacatttcttttttgttatttttttaaatgttacttttttctaatatactatgaagctggtggattcttaagatttctggtcagcattatttgtgatttgcctgagaacatggaataatatatttcttctctgtgtacacagtaaatcagagcctacttaatttaaaaaaatagttgtgcctaatgaatgccacagtctgggccaggctctctgtatataaaataaacatagtttctgcttgtctcatagatcttacagtttggtaaggattaaaaatgctttataaggaaataaatttataattaaaaaggtgaaaagatgcataaagaaatacacaagatgctgcagatttgctcaacatagtcaaaaatctaattaaagaaatgtacaggatgctgtagaaaacaatagcagagtcaacaatctaattacacagtaagtcagtttcttccaaaaagtgacatttaagcccataggcagataaggagcaaggcatgtgaagaaagggcacctgagcaaaaagggtaacttttgctctaggactggggcaaggaaaaacttagcgtagtcaagtacaaaaaagatcaacagaatgtctgcagcccaattttcaaggtgcagaaagtctgaagacagtgtggcagagctcaccaggaaacacaattttcaggcatttgtagaatgtacaagttatccgtgtacataaatggtagaatctgacatatggatcaaaatgctgacattttatttgtgaattgcaagccctctgagttgcaaggctgaagaataaacagaagtgaacaaacggggaaaattaaatgcaataatttatagtgttggcccctgtttctcagagagctcagaggagcacagtatgtttttctcagagacagaaactctttcaggaggcctttatttttttgagatagagtctcgttctgttgcccaaggtggagtgcagtggtgcgatctcggctcactgcaaactccgcctcccgggttcacaccattctccttcctcagcctccagagtagctgggactacaggtgcccgccaccacgcccggctacttttttttatttttttagtagagacggggtttcaccatgttagccaggattgtctcgatctcctgacctcatgatccacccgcctcagcctcccaaagtgctggggtcaggagagttttaagaaagaaacaaaacatggcatcgttttggagaaagaaaacagtggggtggagggggtcatcagtatgaagcctttccattttctgtttttcattagtcaaagttaccactgtgaagaaaggacatccctctactttcaggttgtgtcattgtgctctgaaattctcatggtttactgtttcatctaagttcagaagtgaagggatggtaataaaatggcagaaaaatgcataatagcaaagagagagagagatgtaattgaaggactctgaagaggcacacaggtttgtacctgatatactgtgatgaaaatgtaaatctgatcacgtcacaacaatttttcagtgttattcagtatattcctattgcattgagcataaattccaaaatttttccttctttttgcctttctctagaaaaagaattttagttgttgaaagtagcacacatgaatctgcatgatttcaatgaatgagacttaaaattttaacaggtattgaacataaaatgatagttggccatgagctaagcagtctacatatattatctcatttaatcttcacaacatttgagtgtgcattattattcatattttctagaaactgacacacaagaatattaagtaactttcccaagagagttttaattatgtagcattgccaggctataaattaaagcattctgagcccagaattaaaattctttcttactgtgttgtattgtcctgtgtgtcatttcatagttctagctacaacatttttctatgtattttgcccagttggtctagatctaactcatctagactgtggtacagagcatctcattgtaatggaataatttatggaaaggagaacagctgtgtgaagataaagggctcagtaatgaataagccaggtgcagagacagactggagaggtggaaggttaatataaaatattgggacattagcataaatattagaaaaaatacttcgagggaaaacatgtcaatgaaagtactctcagactaagcaggaggagggtacatggaatagagtttgaatgcatgaacagagtgtttcagtgaaaactgagtggtggtcagattaggtgtaaagtagtataaagtgaaagatactacaggcatgaaagtgtacctgaaagttgatcaatttactttgaaacatctctggagtcacagaaaaaaaaaaaaaaacttgctaaaaactaaaaaaaaaaaaaactttctagaaactattttagaaagataggcaaaatatttcaggagacccttctgaattgttttctcttattcaaaacattaatattgtggaacacggagtctagcataatcagggagaattcaatgtctttaattgtttaagatacataggattctcattgagaagagggctactatctatttatatttaattttgactctaattatattgcctttaatgttttttaaaaaggtgacctgtaatctaaattaccagtttcaaccaaatgttgtcaaaattctctgataatattggcataagataccttcattacattcattttaaagtatccacctgtgaggaagccaattttcctcccttaaataagtacaccatgatcaattaagaatgagcttattaaaaagaaacaaactaataaaatgaaatgggaatttttccaacataatgaagataaaaatgctaaaattaattaagtggttatatgtgaattaaaaaggttataaaaagcagtagcaaatggacttctaaggtctcaggtttgtgtaagtcaaaagcatggactttggagtataacagaattatggaatttaggtcccatcactcaacagatgtagaatcttaaatgagtggcttagtcactgttattcaattttaccatttcatttattattaatagtactactactgataataataataacaataattacaccttcctcatgaactttttttgagatttagatgagaaagtatataatcaaataaagtattcattaaataaatattcttttccctttatctggcatccaaactgaatttctcagtgctaattcgttttgatattttgaagaggtttttgttgtgatgaactcaacagacagactgcaatagttaaagaaaatgtcagtctcctatgaaaaaatgttatacatataatattttaagttatatgatttgaaaagcaaaacagaaaatatttgtcatatttatagtatagatagggagtgagtttgaggataaagcactttatgaagcctaggtaattttacactgattatcataacttagtgagaagaacttttgatttattatacctgtctccctaagtaagataaaatgtttgaacaaaaagtaattttcatcttcaagccttgaactgggtttgggggaaaacagccagttagagatcagcctcttgtgatgtaaggagctgtggggaaaaggatcagttaacagaattcttcatattttgctagaggagtgctggtgaatttatagaagtggtgcaagggcaagttctgtagaaggtcttaactcttgccatagactgtattgaacaacaaatctatttatttaaatcgagatcataccttattactttggatcttcttgggggaaaaataaaaacaatttatgtctatgacgcaataaagcataactattacaacatccacagaagtcaaatccatcctgaaggaaaggatagatggctagtctataaaatatatttttatgaaataatgggtgaaggagaaacaggtacagataattcatgccattcacttatctgatcaccttaagataaatgaaattccatttctttatgtttaaatgtctgccatgaagacttaactgatacatcttataggactgagaatatttttatatgatgtaagctagtctgcaaagatagtctgggagagacatttttcaaataaacaatcaaatttatgtctgctatggtttggctgtgtccccaaccaaatctcatcttgaattgtaattcccataatccccacgtgtcatggaagggacccagtggaagataattgaatcatggggacgattaccctcatgctgttctcgtgatagcaagtgagttctcacgagatatgatggtttttataagggacttttccccttgttgcgcagcacttcttcttgctgctgccatgtgaagaaggatgtgtttgcttccccttctgccatgattgtaaatttcctgaggcctctcagctctgctgaactgagtccattaagtctctttcctttataaattacccagtttcaggtatgtctttattagtggcatgagaatggactaatacagggtctttaatatttagcaaacatatgatagataatatatatgaatatttactatgtgccaactaatgtggtagatgttcaaggtacagtaacaaaacagtcaaatcatggttctggaccacatgagttttggaagtaatgtagaagaacttaacgctacaggaatttaccaaaagacaaggtaccagaatacgtaccctaagctgttatgcgacttccatgaacgagtagcttgtggaaatgttgagtaagtttctcagtgttgtctccactattttttccaggaattgataaatatatcctgagggaaggagaaagcatagtcacacattgtttaaggatgaagataggttctgagaaatgcatacttaggccatttcctcattgtgtgaaaatcagagtgtacttacatgaacctaggatggtacagcctactactacacacctaggtcatatggtacaacctattgctcctaggctacagacctgtatggcaggttagtgtactgaatactgtagccaactggaatgcaatggtaagtgtgtatgtatccaaacatagaaaatgttcagtaaaaataggaaatataatcttatgggaccaccatcatatgtgtggttcatcatccaatgaaatgtcgttataaggcatatgtctataattaaatagttcacatactgaattaactaaatcaccaaactacaagatgcaggacttgtttagagggagactcttagcattaacaaacaggtcttacacattttccccttctgatatgatttggatctgtgtccccatccaaatctcatgtcaaattgtaatccttagtgttgaaggggggacctggtgggaggtgattagatcatggggacagatttccccttgttgttctcccgatactgactgatctctcacaagatctggttgtttgaaagtgtatagtacctcccccttctctctcttcctcctgctgcagccacataaagcatgcttgcttccccttcgcctcccgccgtgattcaaagtttcctgaggcctcttagtcatgctttctgcacagcttgtggaactgtgaaccaattacacctattttctttataagttaccaagtttcaggtatctctttatagcaatgtgaaaaaggactaatacacccttctatactatagagaaaactacaagaaaaggattgaggggttgtcctatagagaatgaaatttgaagataaatcaccctcacacttaagcccctcataggaaaggaaagagaggaaatttcaattagttcctctgacatcaagagaaaactgacatctccgttcccacctggaatgccactgaatcaaagtgaggatttgctaacctgcaccaatgttatcatacaaagggaagaaaaatggggaatggagaggactgtcctggggtcactgttgtgagccatattcatccctccatctggtctttcatgcgtcttcgtgtcttggtggatacagcaggagctcaaatctctgactgctttccacacgggccattcttcagccttgtgtttgaagtgagcaatgctaggggatgagaaaatgtctcctcccatgacaagaagcattgcatacttcctgattcgtagccatagtctcataagagctgaagcagtgcaacagggctattcactggagctgtagtatagaccagtggggctaaaaaaggtaccaaagtgggaagaggcaggaaagaaataccataagctcacttttcacatcctccagtgtcttgctggtgactgcccttagctaaatcccagtagaacgtcagctgaatggggacgtgagggattcagtgcacgtcgggcagccaccttgagcacaaaaaagggcagatgggtgcacagaatggatggagagggcaccagcgtttagagcaagacatggctacacagtagacactgaataatatgtgttgcatgaataaattaatgaaccaatatataatataaaattagccatgtggttgtaaaactcaggagtaaggaagaggaatgaggtacttattatagaatcactgatacatatgagtgtgtggcgtcccagaagacaggggaagacagtggtcacaaagttattggtcaattttgagacagtgcaaggctgagaaatattacatttttccctatgtctgagaatcatatgagatccatttgcagaaatcagaaaatttacatcatcagtcaaaccactcagctgctttccattcaaggcagtgaaatacttcatggtttcacagcacagattttacagccagtaacctttgctctactcttcattagtaggatgaccctcaaaaatgggcagagcggaaatactatttactttgcaaatttgtgaatttaacaagggtttattacttctaaaccaaaaaggtagagagatggtgcaaagcgggttcactgtaccagttaccagtcccaggggaggactctaaacacctttgccctctgcatcttgagctatgccaatttctgtcacttgcatgagtccagtgaggcagaacactgacacacagcaagttccatgtagcagatttattacttacagatagtaacaagaaacaatagaaggctcggattcatgggcaaaccagtcccccaaggctcaggacagctgcccagggcacatgcagtcttccaccgcaccacccgcttgcactgcagtgagggaacctcaaaaagcagccctttctatgttttatactctggagaaacgcaagtcactggcaggacatcctgttctaggagggatgggaataaagtccaggctgtcctggccagttacttgttatatcagaaagttgcattcaaggttcagagacaagccagtgcctacttattcacccagctggcaaatggcaaggttagatttgaaccatgcctgatatattgatataacagggaagtgttgttgttctgatactgtggaggacttaaagcctctctgaaatgtggttactgagataggctgaataaatcccccaaaggcgcaaagacattcacactctgatctccagaacctgtgaatatgttatatagcaaaagagacattgaagatgtaattaagaagacgaatcttaaaatgaggagattatcctagtttaagtgggtaaatccaatgtactctcttgagcccttaaaaacacaaactttctccagctagagtcagagacctgaagcagaagtcatagaaattccagtcatgagagaaactttatacaccactgtggccttattggcttgcaagcccacaggcaaagactggagctaatagaaagcatgagactgaacattggtagcctatgggacctggctttaaatcatattagtgatttaaacaatggaggtgtaattattgatattttctttgggtatctgggttacttgtttgtgatcctgaaattccctcccaaatgtaaaacctaaagagggaaattattgcagtgataagcaaaccagcattttcacttgcactcttgtcatgagacatagtatctgtattatatttctgacatatcacgaatagagaaattactaaagttgttttggtaggacattgtgtgagcttgtctgaaaaatttgccgggattactgtccactctatagttatcacaaaagagctacaactccttcagtggcatgagcaaatgaatgcgtggagtgaaggtatatagaaaaatactttattgaatactggtctaaatactctaaaatgcttcttctttaaccttgaaaataaccataagaggtgtgcatcattatcaacacttaacaattgaattacctgtggctagtatcagtcacgtagcgtgcccgggttaatatctctgttgcatctagcttgcaatccttactttcttaatgtttttttgtatgccatcacacaatgtctataatctcatatctaggatttctcctaatggaagcctcatctgttgttaatcatttttaacaacaagaagagattaagagttaaatccttgggttggttcaagtttattctctaggtataatattgcaaacctaaataatgccatttcaatttaagaaaacataacatcatcaaaaatttgtaaaatgcaaaagaagaaagaattcagcagggtaatttccttaatatagcatgcaagtaagtgatttagtaattaactcttcttgcagattctagctcatgcagatgtaagttatcgagtcactacttcattagctggcatagattagatgtcttctaagggcatatctgtacattttgtgcttcactggtgttacaggactcatcagtatggtctggatatgaaaactctttcattttgtgtttcaatgatagaagaaaattacatactaaatgttgaacagaagaactttctttgagttcaacatcaaaactacaagtggttactgaagtgtgaggttgaagctcttattcactgaatccatcttcacgccaggaaaaggaaaaaaagccaagataacaagcctgcatggattttccagtagtatgaatcaattaaaattcaggaggagagaaaacaaaagtccagagcaatttattaatttgtttacagctgtttgaatatgtaatatgaaacagtagtttggggaatagctgcgggttgggggatatattgattttgatgatattgctcacagaaatagacaagtgcttttgatgtataaactgctacagtgtaacttgtttagtctattgattcatgtgctttgatggagttgtatatgcctgttctgggactcactgaaaaatgagatgccatttcagtgtgtggaataaagagtatatttaaatgtgaaaagccactggattcttctgttattttactggagcttttgttcagttgctcaaagttttttgcagtggcaaccacaatatctgctttttaaagggaataaaaactatgcatccaaaataataaaaatctgaatctgctaaattaaaatgagagatacaatatttattgacttcataaaaatataggaaccttaggagcttttttgtagggagtgataaaattctgagacgaagcaatactttagttatcatagagacaaaataactgagatactgagagtaaatccaatatgacaaggttccatttttgacaatataaaagtagacataagacaccactttacaatgcttgaaaagattttcattctgggttgcaaatattagaaattacttatttttgatttcacatattaggagagatgaggcattacctaaaaataagcatggatatatttaaaaaattttaaataatttttggtgtacatgaatttgaaaatacactttttaagtaactattttctaattgatgcttcataactgaatcaccaaaatggaattcccttatatattattaagtaattttccagaaaagttaactaaagattagaaaatttaataatcatccaggtaaaaaacgttcctgtaaaattcaaatattctgagctttgattgaagtcattgttaacttataccactcttctttcttttcactgccacatagtgaaaactacaatatgggattcactcttaattttattacacagaatgtagctagagaaaatctgatatataccatttaacatatatattcaattactaattatgatggtcaaagaagacacagctggatatctttaaacatgtatatttactagagataaagcacttcctccacttaatgttttacttatatttgaagatcttaataatttgactttgaatcacatggagaattattaaaatgggcatatcagtgctgggaggcaaatcctccgcagagtctggtgttcttgcatgatctgggccttttgagcaagggatgtgattaaacacaagatatccttaaaactagaattggtgtatcctattggagaaatttagaaacagacttccagagccgtaccatgatgttaaagatccattcttatctttctactctccggagacacttgccttcatagcatagtaataaacccaggacaccaacgtcttctaccccagaggagatttacctatatttaagggtattgagtcatctatctcgctgaagggaaggatgaaaagatctgccagcagccccataaagcccagcctctcctagggactgtccaaatttgacaccctaattttgggatctgcacctgtggtatgctccaatgcaggcacaggggacatccaaccatcatcacagcaaggtgctgctcagggtgcagtttgtgctgtaaggaataaaaaatctatttcattgtctgaacaactttttgaccttctgtaattacacacacgtaccatatctatatgtatatcatctatatgtatttgtgtatggaatatatatgtgtgtgtgtatatatatgtgtgtgtgtatatatgtgtgtatatatacacatacatatatcatacgtacacacatacatgaagtactgttggagtacctgtgttagcaagtagagtaagatcttcacagtttgtgatttaacagcaaagcttaaatttacatttataaagttaacaaaaacaatattgattaaaaaagcgtagatttttcagtttataacaacattaaatgtgtggtacattgcataatgaccttctccccaaatgcctgaactctgatttcaaaaacttgtcaatatgttacattaccaagcaaaagggactttaatatgtgattaaagtagatgttatgagatggggagaatttcctagtttatcatacgagccctcaaaagcagagtatctttcctggctaatgttagagagaaagaaaagagaagaaaatgcaggagaaacccaaactgtgagacagacttcactctctcttgttggctttgaagatggagaaaggggtccatgagccaaggaatgaaggaagcctctaaaagttgggaactgcccacagctgaaagccagctaggaaatggggacctctgtcccacagcagcaaggaaattaattctgccaataactgagtaagcaatgaaacagagctccatgtttccaaggccttcaaaaaggaatgcagctccatctacaccttgattttagatctgtgagaaccataccagacttctgacctatagaactgtgagataataaactgtattatcttaagtcatgtagttgtggtcatttttaatggcaccaatcaaaaataagtacaccaagtttatttttgacattccatcaagttgactttgttcacaacatccatttcccccttcttccaaagacagccttttcatttcatttgtgaaatcatgtctccctcattccaatcatgtgtggaaagactgacaacatttttagctctgattggcatatcaaggtatatatttttcttctagaaaatgtttttagttcagggataagcactttccttcatgaaaaccaaggaaacaccaaagtgtccaaacacttttgttgaagttacctctatgttacatttctctccctttcacagacgttggtagggtaatattacaaatcctgagactatagccatctggtagccatgagtgaagaccctgaagcagtggaaaccacaaagagctttagaagatgtagatccttctgaggttactttatctttttccctcaagcctacacattatttttgtaattattgtttatttgaatttgagtctcttttctttctcttgcaatgaaaatagtctaacacatataccatatgttactgtaccccaatttttcattttaaattctaaatttgaagatgaaaactaagtaaaaaaaaaccccaaaaaactctaatatggtatgttagagggactgactgagtggaagagtggcctgtggtgcttattaaaaatgagtaaatgaacacccactatatacttggtgaagaagaatctgagggtgtagacgtccaaagtctgtgtttttataaaattccataatgatttatgaaactcaataaaatttgagaaccgccgtctaatgataactaattaaaataaaaagtacttgcagattgaaattaccaacatataagtttttttcttactcttcatgtataacaatatgttagaatatattcattcgtttagaggattacataaatctaatcatcaagattatatatctgatgttggttaactattaatagcatggtagacatgttttccttttcctttttaatctttagttacactagtcatgctcttttcataaactggacatgttaatgtaataaacgtgcatgttacccaagaagaaccaatggggcataagcagatagtgttatagacagtggaaaaagaaattaactattccattcccttttatgctatagtggaagaatgaaggactgtggcttccacaactcttttggaccacttcaggagtaccaggagttatcagtgttggttgcagatgggaaaggcacttatgacccaggaatagactctgtagagcagcaatgtaaaacaagaaagactatgacctcgatgacatcattagagtcattcaatttagtctcaactggatccagaaccatccttggtcttttcattatataaataaataaaaccagtttttgtcaaggctagtatgaattgggttttatattacttatcacaccttgacctaactctcaaattttcaggaacactgtgtgatcttttataagattttatcactatttgttcttcataaatatttatgcatatttcctgataaccatgaggctcataggttgaaataagatttatgaatggagatttttctttatatatgtatatgattcatagattgcagggatgttttaaagtaatagttcttatagtgagacctccagatcagcatcttcttgtactcttggtaacttgttaaaaacaattttgaaaaccactgatttaaagaaacaaaagaatcactatcatctaactagttggtcagtagtttatatgtggtatgtcataacagaaaataaatttattatcacatagcactcaatattggtgatcctttagggaaaatgcacatttattgtttatagtaactctattagtccattttaatgctgctggtaaagacaaacccgagactgaacgatttacaaaagaaagagatttaatggactcacaattccatgtggctggggaggcctcaaaatcatggtggtaggtgaaaggcatgtctcacatggtggcagacaagagaagacaacttgtgcaaggaaactcccctttgtaagaccaccagatctcatgagacgtattcacaatcatgagaacagcatgagaaagacccgcctccatgattcaattacctgccaccgggtccctcccataacacatgggaattgtgggggctacaattcaagatgagattttggtggggacacagctaaaccatagtcaccctggcccctcctaaatctcctgtcctcatatttaaaaactaatcatgctgtcaccaaaagtcttaactcatttcagcattaactcaaaagttcacagtccaaaggcccaactgagacaaggcaagtccctttttcctatgagcctgtaaaatcaaaagcaattagttacttcctagatacaatgggggtacaggaattgagtaaatacagccattccaaatgggataaattggcccaaacaaaggggctacaggccccatgaaagtctgaaatccagaagggcagtcaaatcttaatgttccaaaatgatttcctttgactttatgtctcacatctaagtcacactgatgcagaagtgagtcctcatggttttgggcagctctgcctctgtggctttgcaggggatagcctccctcctggctagtttcagaggctggctttgagtgtctgtggcttttccaggctcaaggtgcaagctgtcagtccatctgccattctagggtcttgagaatggtggccctcttctcacagctccactagacactgccccagtggggacactgtcccagtggggacactgtgtgagggtgcccaccccacattcccacattttccttccacactgccctagtggaggttctgtatgagtgctctgcccctgcagcaaacttctgcctggacatctaggtgtttatatacatcctttgaaatctaagtggaggttcctaaacctcaactcttctgagcacccacaggctcaacaccacatggaagctgccaaggcttggggcttgcaccctctgaagcaacggccagagctgtaccttggcaccttttagtcatggctggagcagctgggatacagggaaccaagtccctagactgcacacagcagaagaaccctggacccagcctgtgaaaccatttttcctcctacgcctctggacctgtgatggaaggggctgctgcaaaggtctctgatgtgccctggggacattttccccattgtcttggtgattaacatttggctcctaggtacttatgcagatttctgcagctggcttgaatttctccttagaaaatgaatttttcttttctattgcattgtcaagctgcaaaatttctgaacttttatgctctgtttctctttcaaaactgaatgtacttaacagtgcccaagtcacttcttgaatgctttgctgcttagatatttcttctgccagataccctaaattatctctctcaagttcaaagttccacaaatatctagggcaggggcaaaatgctgccagtctctttgctaaaacatagcaagaatcacctttactccagttcccaacaagcttcttacttctatctgagaccacctcagcctggatttcattgtctatatcattatcaacattttggtcaaagccattcaacaagtctctagggagttccaaactttcccacattttcctgtcttcttctgagccctccaaactgtcccaccctctgcctgttacccagttccaaagtcgcttctacatttttgggtaccttcagcagtgtcgcactctactgataaagtttactgtattagtccgtttttatacttttgataaagacataccagagactgggcaatttacaaaagaaagaggcttaatggactcacaattccacatggctgtggaggtcttacaatcatggcggaaggtgaaaggcacatctcacatgggggcagaccaaagaagagagcttgtgtagggaaactcccctttataagaccatcagctctcatgagacttattcactatattgagaacaatgtaagagagacttgcctcataattcaattacctctcaccagatccctcctactatatgtgggaattttgggagctacaattcaagatgagatttgggtggtggcacaggcaaaccatatcagtaacatactttgaaaaggaagaaatagacattgttttttgaagataggttattgataaaatggagaaatgtttctcttgatacatacattattttctcagtcgttgttgagtgaattatggtaacttatttttagctctgcatataaatttttccatctttattctagttaaaaaaactgatacagcacactgaaatagacatgtcccaggtctatctatgccccatacatcttttattggcaatattaactggtctaagtgataagcaaatgacaaagtatccatagtttttttaagaactactctgtaaacattgcaaggctgaattaatttttttccactgatgtaaaactatactttgaactatttagggaaagaacttggcagaatgaagccaagtaaggacaagcaaaaatgatacatggatatgcaaaacaaaaacaaacaaaaactagaaacaaaagcactagtacaaatctgagcaatttctttgatcttgtgaactatttttgtacttagtacttaagaaaaattttttgctaataatttgactttggtgtctgccatttgccaataaaataatctttaattatatgcataaacagagactactaaatatgcatatatttaaaaaggtagcacttagtatattagtgttcacaactttgcccagtgaattttattaatctatttttttcataattggtaactttatccaagtttgctgattcttgatctgcttaccaatatcaaaatgatttggatgttcccaaagacaccaattattttcttaataaccattataaaaatagtatttaaataatctgatttttaatagtaattggatgaaaacaaagatacactggttattcttttatttacattttaattctaaaatattatttctaataagtaaaatattatcttaaaatatgagcagtatgtttaatagttaccaatttttgttaattttctttatgtataataaagttaccaattttttaaatttttcctttatgcatgataaagggttcttacatctgattttgaatcatttgaaaaatttttcactttcttgatgacattgtttgctgcccacacaaaaataattaatttggacatagcccaacttatttataattttcttttttgcttgtgctttgatattatacctaagaatacattagctaactcaagttaataaagatttacttcctcatttttttcaaggagttttgtaggtttaagtctcatattgattctataatccattttgttagttttgagtatgatgagaggtcagtctccttcttcattctttttcatgtaaatagcctactatcccagcagaatttattatgaagacatcttttactttattaaattgtcttgtcactgttgaacgtcaatgaaccataaattcttaatatgatttcattgatctacaattctatccttatgccagtaccattgtctcttgattactgtatctggtagtaattaaaaagtgtgaattctgcaatttgttcattggtttcaaggttgttttcgctattcagtgtttcttgtatctttatattagtgatatttgtaataaaatacagctgaacttttgagaagtattgtgtttaacttatagaccaaattaagagcattgctacttgaataatatcatcttcttattcatgaatataggatttatttatttatcttgacatttaaaatatttcaaacaatatattgtacttttagtttacaagtaacttattttgttaaatttgtactattttatcctttttgattgtataaaaatggaattatttacttaatttcatttggaaatgtttatcactactgtatagaaataatatagattattatttagtgattttgcattacattaatttactaaatttgctgattaattatataagattttctatataaatgtcatttacaagtggaaataattttatttattcatttccaatttcagttttttatatctttttcttatctagttgcactggctagaatttctagttcaacattaaatcaaagtagtgaaaacagatatctttgccttgttcctgaactcaggggatgcattccacctttcaatgttaagtacaatgtttgttgtgtgtttttgttgatgccttttgttaagttgtgaatgtttcttatatttacaattcttcagtattttgaaaggatcttttcaactgcttttactctaatattgatgcaatatttagatatgtatttttaactaacctaagccaacattgaaatactattattacatttcctgtatagatacttcatacctgactattttcaattcttctcctcaccctttgtgaaattactattattaattttacttatctacatgttatatttactcacatattattttattttatctttaggttaaatatcattaagaataaaacaagattatattttaccttcattttttttcttccctgatacttctctcttctttgtatagatccaagtctcagatatatatcatttttttatacctgaataacttttaacatttttttcaggaagggttttctatcagtgaattttctcagtttttgtttaacagaaagagattttatttctctttcactgttggtagataattttgccagaatagaattataggttgggttatttttcttttataaatcttttagatattccactctactcatttgcttgcatggtttctgatgagttgtccatagttcttatctctgttccactataggttttctatggcttctttaaaaaattttccttggtatttggttttctgaattttgaatatgacataattttgtgctttgtttgtttgattcatttttgtttctctttctgttttcctttgtatttatcctgattaatgatttctgaactttctggatttgtgatttactgtctgtcattaattttgaaatgacctggccattattacttcacatatttcttctgttccatgctctttttcttcttctctaaattatatatatgttgctaattttgaaattctgccacagttcttgcatgttctgttaggtgttttttctttctttttttgttgttgttctgtttgaattgcaatttggaatgtttctattgacctaggttacagttcatgaattctttcctcagctatgtccagtctgctgatgatctcattgtaggcattctccatttctgttgcagtgttttttatttctagcattccattaattctttattactttcaatctttctgcttgcagcactaatatgttcttgcatgttatctaattttttattagttctcttaacatattagtcacagttatttaaaatccctgataattccaaagtctgcatcatatctgaatctgactctaatgcataatttggctcttcagactaaatttttttttgtcatttcgcatggcttgcacttttgttgttgttgttgttggaagtcatacagtatgtacagtatgtatcagataaaagtaatgaaagtaagtaggtcgtcagtgtgaggttttatgttactctgtttaggagttagactgtgtttaacgtttgctgggtgccagacacttcagatgtttccagtgtctttcttttggtcctctgtgttgtctttgaactttcctaagatcacctcttcagatagaggctgcatcacacagctcttcagacgtactttatttttaatgtactggatccctgttgcgatggtgataaggtgcattagaaggggaatattgtgtagtgttatgattaaatctcagtcttttcatgaggctgtgtctcctggctgtgcttgtcacaagtgcttcttcagtggtatcacttctgcctgctactgcctttctcggctgtagcattcccaacttatgtccttgaagttctgacctctattgactatatttttatcacacttcagtagaaaaagactagaaagagattgaatgggaagaatccccttcctccatccgcaataaggctttggaaaattttcctctggagagtagccttcttcttatggagaaagttctgcatgtgtttcacaataattacttttccctttttcttgacaaatctgcaaaggatctttactgaatcttcactgtgaaaacctggttgggccacttgaggtaatgccaataacaaatgggtatccctccttcaagaatgggttccccaggggttcatcactcacactagctcacattcagccttcagcaattcgtcaatactgccatttgagtgctcccacaatcgtgacagcacaagttggtcagaatttggattcaaataggggaataaaggaaaacaagtcttttgtttgttttaaaattagtattatgtgctgggcacggtagctcacgcctgtaaacccagcactttgggaggccaaggtgggtggatcacctgagatcaggagtgcaaaaccagcctggccaacatggtgaaaccctgtttctactaaaaatacaaaaaacaggcgggtgtggttgtgtgcgcctgtggtcccagcaactcaggaggctgaggcaggagaattgcttgaatccgggaggcagacgctgcagtgaaccgggatcgcggcactgcactccagcctgggcaacacagtgagactccatctcaaaaaaaaaaaaatagtgttataaaagactgattcatgtttttatattattttgaattaaatgaatatttttaaaagagtattatgaactttctttttaattatggcaatgtctaaatttatatcttcatctgagtcttctctgtagtgtcccaaaatattattattattatacaatttggatgtcctagaattaaaaacaacaaaaacatcaaaatttctctcagtaactccatcaaagttgctcctacttctatgttctaaatgtcaattttaaaaacgaataaaaacctagtcagctaggaaacagcctgggagttagactagtctcctgttgtttctctcttgggaaacgtatgatcactggtcttctcaatttcatactgcccctgctccctcataatattcctcatgtagcacccaaggtctacttgaaaactgtaagccatattatgtcattacggtcttcaaatttttaatatttcctcatcaataaaatagttcacgatggtctttgatgtttgtgtaaataattgacattcacagaaactctaaggctttgctatattcagggtaccactgtggcaaaatacagacaaagtttcctgtttgtgtttggaaagtctgatgcaacatggctctaccatcataaccacaatgtagtgtcctgtggatcaatgactgagccaaaagcaagaatctgtaggctgggtattaatgaggacccccacacatcggtgtggtttgagacttcttgtgtgaatgcaaaactccaaatggtgtttctgcttttattaaacatggatgagacactcccaatgggtatttctctattgtgaagtgtgatattgatgtacaaggaggagaaaatcaaaacacagaaatttaaaggaatcaaaatggatacaatgttaacaagtaaactgggcaactgcctcttctgttgtgtattggaaaaagaggaggcactgatggaattctccatgagttctgctgtacactgcagcttttgaaatctgagtctcacaagaatctttacttttattgaactgcttttgcttataatttcttacatatctgatatgcacttaaagtacattcacatcacccacaattaagcagaattgacagtctaataattatttatttttatattagctttcagacttattccccttttagtcagaatttaaaataaggatcttaatccaatagaatgtaagtcctgtttcagttcatgtcaggaagccaatatgagacttaaaaatattaggttagtaaataatatatcacattaacttaaaactaacactgatttcagacaagtctttgagataaatagataacttgatatgtttataacatttcaaagtaaacagagttaacataaaagtattttataaatttagaaaacaaaatttaaaaaccaataatcattctttaattacatggtaactataaattgcaaggttttgattactaaatgattgtacttacatttatgtggattctggttcaaaattcaatttttgaactctgattgaaaggaaaaaatagtaataacacaatgatgtgctaatttgtaaatatatatgtcaattcgatataaaaatttatgttatttagagtttttgccctacctaaaaatctagaaaagatttccatcaaaatattatgaagaaaagtaaaatagactaagtatccacatacttcatataaaatagcaactaattgtaagctttaataattaaatagttttactttaatagttaaaaagcatgtttaattttgcaaatgatacagatttagtgttttagcactctgtgacttaaatgactctgtggaaaactattttatcatgaaaaatatacataacaaaaaaatatttaaaatgttttaatatctgtttgtgaatcttgtttcatacgcttgtattataattcaaataataaaacattgtacatacacatatatgcataaatatttttatatgtatcttttacttccaagttcttttataactaaaaatgctatatggaaaatagaagggaacaaacgtgagctttcattgacaatagttggaaattttcaagtataatcagagaaaaatatgaaaaacaaacatctatgttaattataagaaaactgggatgtatgaatcagggaagatgtctgtgaattctagagacatactcactataaactaactgaccccattaccaagtattaggctagacatttttaacaagagaacactcaattgtagaaggttggaaaaatcttaagagatgaaaaggcataattcagcggtctggcacatagattcatatactaccacatttatattacttttctttattttccttccttgtaacaaagcatcaggaaatacacaagcaatgtactaatatttatttccaattacccaacacataaacatactgcagtaatggaaaaataataccttattcttatgattctttaaatccattaatagtattttgtattttcccaaaacattgcatgttgaatgtcaaatatattttttcacattaacaactatgattaataaataataatttttttgaaaacctggaatgaaagagttaaaatgatatgctgtttgattattatagaagaatcagaaggagattctgatctaaagatgagatgtattccttaggcttccaaccattaagccaatgtgactgcctaagaggaattataccttcctctaacataaacagccatattcatttgcagaagatgatacacacatgtagtatactacgtggcccaccaacatggtgcaatagctatcttgatattgtgaaagggcctaaaattaaatgctgcaaatatacgaaatgaaagaagactaagaagtgcaagaaaaaatgaattactttgtaatgtttctcttttgagattaaagtataaagcactaaaaagatttatgaggaaaagtggtattactcttaatgcaacgggaaataaaagactgagtaaaagaaagatgacaatggggagaaaacaataaacatctatggcttttatttgtaatttctgaaggcattcaagtgcttcaaaattattaaaatctaacattatacagtaagaaaaaatatacttaattttctcttttgttaagtaatatttttagatttattaaaattattattttgagacatagttttgatatcataatttacttgactaatttcctttgatagaaaatgagttgttgatagttttttactaatataacaatgctgaaatgaatgaaaactaacctttgaaagcacgactaatgctctagaaagctaaagttagaaatatatgaagttgttggtgtttgatcatttggatgtacaaaatggaagtttcagattgttcatctgaaccttactagttctttgttttcacagacaagaaaattcctctagtttagagaagacaaatagtttgtgaaatgtcagttagttaaccagtatgaaaatacagaatttgagctcagtttgaggaactaaaaacttgttttgattttccttacaaagccacatgtgttcagttctttaagccggtcagtacttcattaagctagttttgatcaccaacagatatctgcattaagtcctgctatgtaaagtattaggctaaaacatatgaagttacgctaacagctataaacaaggattttataattgtatagcacaatattgcctgggaatagtgtcataatttaaatattttttatttacttgatattatatatatatatcacatattagagttctttaaaagtcttaatgcaaatggatcatacagctaccttacaataggtaacagttacatgttccaattttatcaaaatagtctctcactgtatattctatatttagacagaagctgctatatactatgttaaattataaaatgttttctacataacctgggagaactgccccctaatcaccaatctttctttctctccctgttctcgtttggttcagccatatgcttaatctactttgtgaagaaaaatacaagatagtttgttgtgtatttatactaattatttgggttcctcaagcaatcatacagcacagtatgtcccttatgtattgattagtacctcttcccaattttgcatcattgtgtgtttttctgattatgtatagctgattcacagtcatttgttaaacattgcccattctcccttcagttaaaggaattctagtttggaaaacaagccaacaaacaaaatcagatgcattgaattagagtatacagcgataactgaaattctgcatgtaatatcccattaactgcttggattccttccacttatttggttttaggtttataatctgcttatcctgctcatgtatttaacatggcacaaagagattgtacgtttccacatctatttttatactttgccttggttgctctgtggaaggtatgcaaatctaaagtcaaaggtacaagagcttatctaagtgtgaggtcagatatgagtgctttggttactcatatctgagaccacaatcagcttgcatctaattatctcatgaatgatgacagtgtatgtccataattgccttcttcctaagagtgctgctgattcactgactcattaaatatgaccatttactctattttgtattgtggaagggcaatctggcaacagaccactgatgccgaagggcaagaagctaatcctaaccactgtatatgagtgacagagaagtttgtagaacacaaataaaattaatatcatttaaatgaagaggacttgagaaaattcatagaatttactttgaaatgaagcaaatatgaaccaaaatgtcagggtatcatttaaatattttattaattacaatttataacaaaatagtattcagataattgcaataaatatttaagaatcttaaatatgttacccagtaattgactatcttcatacaggaagtaaacttttagcattgacaccatgaaaacattaacacaaatgcctgtatcatataataatagttaacatttaccgaatacttatctttttccggaactggaataagttcttatatatattagcttgctaatcatcacaacaaacctaaaaggtagcattactctcgttatttctgataagggaactaaatcacagagcagggaagtaacacccaaaacacgataaagttgcaagtcaaggccgcaatttgactatgatcattgctctctactgctatcctagacattatatcaattatattattgttttaattattttatctaccatgtacccacttctgagctctctgccatgaggttttgaaaataagttgacacaaaatctagttgtgaaaagaagggtaacacatgatatgtttggggaatagtcattacatgatgacatactaattgtaacttttaataaaagaatgttttgcataggatcagtcaggccccctagcggaagtactgacacttcaactagccttgaagaagatagaacatttgtataatcaaagacagaaggcaattcaagtaggcagagttcacaatacataaaacagtatgaataacaataagaataggatatattagaggtgtattgacttttttcccctcaaactctggacatgtttattacctttttaaagaaaattctcatggtttacatcttactcataaattcttcctagattctgacttaccaaacttttgagatgtgcctatagattataaacctcacctaacttatactcataacttggtgcttttagttttatgtctgtacatgggcatagaaaacttggcactcatagtttcttttaaagaaagaaaattaatgtgataaataagctgaatgaaaatatatatggtcagaaatcagatgaaactataaattaatgagactggctttattacagggcttcacaatgaccttgaaattatatcttaaaaaaaagcttcagaaatattgtgcgcatgagatttctttaacaataaattatcagtttcttcactatttgaagcagcaaaattctaaagcctgtgaagataacattatataataaaatctagaaaatcaaggggttatacttgagtatagtatctcaataatttttaagaaggtatctatgctggaagatctgaatgaactaaggcaattataccggcactaaaactgtagctctgacctttgtgtcaaccaaagaaaataaaaaaaaacgatagattacaaagctctttctaaaatcaatggctagttttccaaagtgaactttctgagtatctgtatttaaaaatttattactgtgtaactacatttcatatatttaccaccttgaagggatatcatgagtagaattactagaggtaaaagattagtaaacacttgctgcctggttgatattgaacgtagctagtacaatagtgatgcaaattaaacttcataagctcataggccacctgacctttagatgccatacaagatttttgggtgtggtggtaatttcagtttcttcttagaagttaaattctcataatattggaatcttgaaaataaacatatatttttaaatttttctgtgtcaattttcagcaagatacacagctatttaatataaagaacaactttctcattttggtagatagacacaaaagtatattcagatgctggagaggatgtggggaaataggaacgctttttcactgttggtgggagtgtaaattagttcaaccattgcggaagacattgtgctaattcctcaaggatctagaaacagaaataccatttgacccagcaatctcattactgggtatatacccaaagaattataaatcattccactataaagacacatgcacacatatgtttattgcagtgctgttcacaatagcaaagacttggaaccaacccaaatgcccatcaatggtaaactggataaagaaaatgtggcacatatacaccatggaatactatgcggccataaaaaatatgagttcatgtcctttgcagagacatggatgaagctagaaaccatcattctcagcaaactaacacaagaacagaaaaccaaacactgcatgttctcactcataagtgggagttgaacaatgagaacacagggaggggaacatcccacactggggcctgttggagggtggcagtctaggggagggatagcattaggagaaatgcctaatgtagacgacaggttgatggatgcagcaaaccaccatggcacatatatacctatgtaacaaacctgcatgttctacacgtgtatcccagaatttaaaaagtataactaaaaaaaaaaagaaaagaaaaagtatattcaacgtgttttattagcatttctaagtgacctatcacttttgaagtataattcaggctgtagtgtcataaaaaaatctgtagtttgctgttttcttttaactttacataatgagttattctcttgcaattaaatactatggggaaaattatagaaatgattcaaataatgatatatgatctaaaaagtaataggttactagacaactaagaatatgaatgctgaaataacctaaagaaagcctaaattcaaaaatttatgtttacacaaaatgatctaaagttcttttttaatgaatgtcaagcatttaagatatatcagaacatatgtgtatctatgtattttaaattttaaacaaaatatacaagacacactctttaagaaaaagattactactgaagtaatcaaacagtgtcactttgataattttctgacagacacatgggaataggcaagactatgaattcttgattcaagttgagtggagctagttgaaaagcaaaataaaaggaaaaatgatggtgacaaaattaaatataaattaatattttttttttacacatagtgtgcacttcatcctagcttgtgttttacttgttttatattattttaaaggatttttgcttaagtcatgtagaaaaagatctgttcagttgaaattacctaggcccttgttactcaaactgtgtcactttgactggcttacgaaaaatggaaagtctcaggccccatgccaaacctaataaatcagaatcggttcttactaaccttcgcactaaagtttgagaggcactttttcaggatattttattctaactaaaaacagcctgagatatcaagtttctgcaattgtgcaaatccttatcttgtttttcattcttaatgtaaaagcaccttgaaaccagtgctcacattcatattctcaacaatgtgtactactttcattaaaagaattacttttaaaatgaataaatgcatgaattactaatacatattttctctttggttaaagtggggaaaagttttacaaaaagataaagaaattgaagttaaattggccaatgaatctcagaggaatagaagagctgatggggacagggagaaagatctctttcttaggcgtataaggactcacaagactgatccaattccattaactttcatgtgcaagtccctgaagctctgtaatttgatgaagcattgctagcaagaaaagcagaaaagtaacttatatttctttccttttttgattttagctaaggagtcaaaatgaacaaagataaacttgaagataaaattgaagaacttttggttagattaagaaaaaagagggagaaaagtcaagatggctgaacaggaacagctctggcctgcagctcccagcaagactaacacagaaggcgagtgatttctgcatttccaactgaggtacccggctcatctcattgggactggttagacagtgggtgcagcccacggagggcaagcagaagcagagtgggggatcgcctcacccaggaagtgcaaggggtttgggaactccctcccctagccaagggaagccgtgagggaccgtgctgtgagggacagtgctatccagtccagatactgcacttttcccactgtctttggaacccgcagaccaggaaattccctcgggtggctacaacaccggggccctgggtttcaagcccaaaactgggcggccatttgggcagacaccgagctaactgcaggagttttcttttgtactccagtggctcctggaacaccaatgagacagaacagttcactgccctggaaacggggctgaagccagggagccatgtggtcttgctcagtgtatcccacccccaacgaagcccagcaagctaagatccactggcttgaaattcttgctggcagtacagcagtctgaggtcaacctgggaagctcgagcttggtgaggtgaggggcttccaccattactgaggcttgagtaggcagttttgccctcacagtgtaaacaaagccctggaaagtttagacttggcagagcccaccacagtgccacaaagccaccgtagccaaattgcctctctagattcctcctctctgggcaggataactctgaaagaaaggcagcagccccagtcaggggcttatagttaaaactcccatctctctgggacagagcacctggggaaaggggtggctgtgggcacaggttcagcagacttaaactttccttcccgccaactctaaagagagcagcagatctcccagcacagcactcgagctctgctaagggacagactgcctcctgaagtgggtccctgacgcctgtgcctcctgacaaggagacacctcccaacagggcttgacagacatctcatacaggagagctctggctggcatctggtaggtgcccctctgggatgaaacttccagagaaaggaggaggcagcaatctttgctgttctgcagcctttggtggtgatacccaggaaaacagggtctggagtggacctccagcaaactccagcagacctgcagaagagggccctgactgttagaaggaaaactaacaaacagaaagcaatagcatcaacatcaacaaaaagacaaccaagcaaaaaccccatgtgaaggtcgccaacatcaaagatcaaaggtacataaatccacgaagatgattaaaaaccagtgcaaaaagtctaaaaattccaaaaaccagaatgtctcttctcctccaaaggatcacaactcctcgccagcaagagaacaaaaccagagtgagaatgcgtttgacgaattgacagaagtaggcttcagaaggtcagtactaacaaacacctctgagctaaaggagcatattctataccaatgcaaggaagctaagaaccttgataaaaggttacaggaactgctaactagaataaccagtttagagaagaatataaatgagctgatagagctgaaaaacacagcacgagaactttgtgaagcatacgcaagtatcaatagccgaatcaatcaagcggaagaaaggatatcagagattgaagatcaacttaatgaaataaagtatgaagacaagattagagaaaaaatatgaaaaggaatgaacaaagcctccaagaaatatgggactatgtgaaaagaccaaaccgacatttgattggtttacctgaaagtgatggggagaatggaaccaagttggaaaacacacttcaggatattatccaggagaacttccacaacatagtggaacaggccaacattcaaactcaggagatacagagaataccacaaagatacaccttgagaagagcagccataagacacataatcatcagatttgccaaagttgaaataaaggaaaaaacgttaggggcatccagagagaaaggtcaggttacccacaaagggaagcccatcagactagcagtggatctttctgcagaaactctacaaaccagaagagagtaggggccaacattcagcatgcttaaagaaaataattttcaactcaaagtttcatatccagccaaactaaacttcataagttaatgataagtaaaatcctttacagacaagcaaatgctgagggattttgtcaccaccaggcctgccttacaagagctcctgaaagaagcactatatatgagaaggaaaaagcagtaccagcctctgcaaaaacataccaaaatgtaaataccattgacactatgaagaaactgcataagctaatgggcaaaataaccagctagcatcataatgacaggatcagattcacacataacaatattaaccttaaatgtaaacaggctaaatgccccaattaaaatacacagactggcaaattaaatagagtcgagacccatcaatgtgcagtattcaggagatccatttcatgtgcaaagacacacaaaggctcaaaataaagagatggaggaatatttaccaagcaaatggaaagaaaaaaaaacagcaggggttgcaatcctagtttctgataaaacagattttaaaccaacaaacataaaaaagacaaagaatggcattacataatggtaaagtgatcaaagcagcaagcaaagctaacaatgctaaatatatatgcacccaatactggagcacccagcttcataaagaaagttcttaaagacctacaaagagacttagactcctacacaataatactgggagactttaacaccccactgtcaatattagacagatcaacaagacagaaaattaacaaggatattcaggacttgaactcagctctggactaagtggacctaatagacatctccagaactctccaccccaaatcaacagaacatacattcttctcagcacacatagcacttattctaaaactgaccacataattggaaggaaaatactcctcagcagatgcaaaagaactgaaatcataacaaacagtctgtcagaggacagtgcaatcaaattagaactcaggattaagaaactcacccaaatccgcacaactatatggaaactgaacaacctgctcctgagggactactgggtaaataatgaaattaaggcagaaacataagttgtttgaaaccaatgagaacaaagacacaatataccagaatcactgggacacagctaaagcagtgtttaggtggaaatttatagaactaaatcccacaggagaaagtgggaaagatctaaaatcaaaatcctaacatcacaattaaaacaactggagaaccaagagcaaattcaaaagctagcagaatataagaaataactaagatcagaaaagaactgaaggagatagagacacaaaaaacccttctaaaaatcaatgaatccaggagctgattttttgaaaagatcaacaaaatcgatagcttgctagccaggctaataaaaaagaaatgagagaagaatgaaatagacacagtaaaaaatgataaatgagatatcaccactgatcccacagaaatacaaactaccatcggagaatactataaatacgtctacacaaataaactagaaaatctagaagaaatgggtaaattcctggacacatacaccctcccaattcaaacaaagaagaagtagaatccttgaatagaccaataacaagttctgaaattgaggccgtaattaatagcctaccaaccaataaaagccgaggaccagatggattcacagcctaattctaccagaggtacaaagaggagctggtaccatttctcctgtaaatattcaaaacaacagaaaaagagagactcctccctaactcattttatgaggccagcatcatcctgataccaaaacctggcagaggaaaaataaaaaaagaaaatttcaggccaatatccctgatgaacattgatgcaaaaatcctcaataaaatactggcaaaacgaatccagcagcatattaaaaagcttatccaccacgatcaagtcagcttcatccctgggatgcaaggctgcttcaacatatgcaaatcaataaacataatccatcacataaacagaaccaatgacaaaaaccacatggttatctcaatagatgcagaaaaggcctgcaataaaacttaacatcccttcatgataaaaactctcaataaactatgtattgattgaatgtatctcaaaataataagagctatttgtgacaaatccacagccaatatcatactaaatgggcaaaacctagaagcaatccctttgaaaactggcacaagacaaggatgccatctctcaccactcctattcaacatagtattggaagttctggccagggcaatcaggcaagagaaggaaataaagcatattcaaataggaataagggaagccaatttatctgtttgcagatgacataattgaatatttagaaaccccattatctcagcccaaaactccttaagctgataaacaacttcagcaaagtctcaggatacaaaatcaatatgaaaatatcacaagtatttctatacaccaataatagacaagcagagagccaaatcatgagtaaaatcccattcacaattgctacaaagagaataaaaggcctaggaatacaacttacaagggatgtgaaggaactcttcaaggggaactacaaaccactgctcaaggaaataagagaggactcaaacaaatggaaaaacataccatgctgatggataggaagaatcaatattgtgaaaatggccatactgccctaagtaatttatagattcaatgttattctcaaagagctaccattgactttcttcacagaattagaaaaaaccactttaaattttgtatggagccaaaaaagagcccgtatagccaagacaatcctaagcaaaaagaacaaagctggaggcatcacactacctgacctcaaactatactacaaggctacagtaaccaaacagcatggtatgggtaccaaaacagatatatagaccaatggaacagaacagaggcctcagaaatgataccacatatctacaaccatttgatctttgacaaacatgacaaaaacaagcaatgaggaaagaatttcctacttaaaaaaaggtgttgggaaaactggctagccatgtgcagaaaactgaaactggaccccttatacaaaaaatacaccttatacaaaaaataactcaagatctgttaaagatttaaatgtaagacctaaaaccataaaaaccctagaagatactttattacaaagctacagtaatcgagatgtgtgatattacatgaggacagacacatagatccatgggaccagatacagaacccataaataactccatagaagtatgagctgattttataaaggctcaaaaacaatttaataatagtggtgaaatattagtcttttcagcaaatggtgctagagcaattagatattcataaccaaaataaaataaaaggaaaaaaaataaaaaagaatctgacctaaacctaataccttttttttttttgagatggaatataaaactataaatactttcagtgatagcataggagaaaatcctcagaacctagggctgagcaaagaattcttagacttgactcctaatacacaatctgtaaatggaaaaaaaatcactaagtaggactaaattcaaattttaaaatattgactttgtaaaataccctaagatgatgaaaagacaagcttcagactgaggaaaaatatttacaaaccctgtatctaataaaggactgccacatagaatatataaagagctctcaacattcaactataaaaaaccagccaattaaaatatgaataaaaggcatgaagatacatttcacctaaaaaaatagagatggcaaataaacacatgaaacaatgctaaacatcattggcattagtgaaatgaaagtagaaactactatgagatctcactacacatctaaaaaccaactaaaacattgtgacattgtgaaatactcttaaggatgcagagaaaatagatcacttggacattgctgatggggaatataaaatgatacagtcactctggagaatagaagtttgtaaaataaacaaaatatacacttaaactatataaccctgcaattgcacctctggccatttgcctcaaagaaatgaaaacatatgtccaaacaaaaatttgtacacatttatccatagcagctttatttgtaattgctcagagtttaaaattaccaaaatgcccctcaatacataaatggctaaaaacaaagcaaaacaaaacaatctgtagtacatccatgccacgaatctccagtgaagtattttgagtaaaaaaaaatcaatttcaaaaggttacatagtgaatgaattcatttatattacattttttaaatgacaaaatacagagatgaataacagattaggattgttgggagttagggatagtggaggagtgggtggaaagggataacagaagggagatatttgtgataataaaagaattctgtctcatggttgcagtggtcattacataaatctgaacatgtgatataataacacgtaccgatacttacacattgtgccaatgtcaaattcctggttttgatattttactaaaattgtatcagttaaatcattgaaagggtacatgggtcctctctgtggtaccttggcagcctgctgtgtatataattatctcaaaacaaaggtaaaaaatcgttaattatctacaaataaatgcattatttatttatttatttatttttgagacagagtcttgctctgtctcctagggtggagtgcagtggcgcgatcttggcttactgcaacctctgcctcccgggtccaagcgattctcccgcctcagcctcccgattagctgggattacaggtacctgccatcactcccggctatgttttgtatttttagtagagacggggtttcatcatgttggccaggctgatcttgaactcctgatctcaggtgatcggcatgcctcagtgtcccaaagtgttgggattacaggcgtgagccactgtgcctggcctaaaattgcagcaaaactttaaagtaaactaagctctagacccacacagtaagccttatatgtcaggcaatatttgtatctatctcgcttttattaaagcctttctacacgagtgtggtctacagactcacacagcatcagtgtcagcgtcgcccagaagcttgttagaagtgcagcacctgcaatcccatctgacatctactgtgtaagaatctacgttttgacaagatccccaaagatttgaatgcacattaaagtctgagtaacactgatctaaaaggaggatgttgtattattttaaagcttactcaaaatcgcagtgagttttgaaacccctagtctaatcaactcagtcagttcactattgctttttcaagaaccctggataacccgggagaccaacctgggtaaatgtgaatgattcaaactttgcaacctgtaataaggcattgatggaatttatgatttacctaactgtgctttcctctccacaaggaaaaagcctccctcgtctttattgctaatttaagtgcattctgcagttctttctactgagtgtggggagggagatggtccatgatatgtacgggaactaaaggatcttttgaataggattatgtttagctcagattcatccacaaaatccaacattttctttttataatatacctgtaagacataacaaaatgccaaatgattgtaatattgctattgcaacctgtcccttaagaggaattccttaatagagtatatttattttaaaaaataaaactatgacaaaattttaagtcaatagaatattttcacactttaaatctgatggttctattgtagtttgagttatggcttaccttgcaattctatattttagtattacataaatgtaattttctaatgaaattatatatatgattatgttttatagttatagtaattccattcctaattccatgaaaaaaacttttctagtacattacagaataacattaaacaggtacacaatgtgtaataatcatatcaagaacattacagaataatgttaaacaggtacacaatgtgtaataatcatatcaaggtaaatgggatatccataacctcaggcatttatccttttgtgatacaaacaatgcaattatgctcttttagttatttttaaatgtgcaattacattatttatgactatagtcaccctgttgtgctatcaaatactaggtcttatttattcttcctaactaatttttgaacccattaaccactctcactttcccccagcccccactatcctttccagtgtgcagtaaccatccttctactctcaatctccatgagatcaattgttttaatttttagctccccaaaataagtgagagcatgtgattcatacgtttctgtgcctggtttatttcacttaacataatgacctccagttccatccatgttattgcaaatgacaggatctcattctttctatggccaaatagtacccacttgtgtatatataccatattttctttattcattcatctcttgctggatacttacgttgcttccaaatcttgactattgttaatagtgctccaataagtgtgggagtgcatatatctcttccatatgctagcttccttgcttttgggtatataccaaaaggacggttcctggatcatatggtagctctgttcctggatttttgaggaagctccaaatggttctccatagtggttgcactaacatacattcccatcaacagtgtacaagggttcccttttctccacagcctcaccagcatttgttatcacctattttttggatataagccattttgactgtgatgaaattatatatcattgtagttgtgatttgcatttctttaatgattgctgatgttgagcatcttttcatatacttgtttgacatttgtatgtcttcttttgagaaatatttgttcagatcttatgcccattttataattagattatcagatgttttttcctgtagaattgtttgagctccttacatattctagttattaatcatactttgcaaatattttctctccttctgtgggttgtctcttcactttgttgcttcttgtgcagtgcagaagctttttcacttgatatgatctcattggttaattgttgctttgattgcctgtgttgtgggatattactcagaaaatttttgcccattccaatgtcctggagagtttctgcaatgttttcttttagtacttgcataatttgaggtcttagatttaagtctttaatccattttgatttgatttttgtacatgacaagagatatgggtttaatttcattcttttgcatatagatatccagttttcccagtcccatttatcaaagagattgtcttttttttacaatatatattcttttgcatctttgtgaaaaatgagttcactgtagatgtatggatttatgtctgtgttctctattctgttccactaatctgtgtgtctgttttatgccaatctcaggctgttttttttactattgctctgtagtataatttaaagtcaggtaatatgattcctccagttttgttatttttgcttaggatagctatggctattctgagcatttgtggttctatatacattttagaattttttatgatttctgtgaagaatgtcattgatattttgatagggattgcattaaatctgtagagtggtttaggtagtgtagaccttttaacagtattaattcttccaacccatgaacatggaatatctttacattctttgtgtgttattctgtgggagtgatcagactgaacaccaggtcgtgggggtgacaaagtctggtggagtcaaaggattgagaaaagactgtctgagagagagaagtgggaccagggggccattgcgatcatggaggctgtgaaggccctgagatctgagagcccacactatttcttggtaatccagcaaagaaacagatggtgagaatgtggaggtcgaaggggcgcgttgcattaagcacatgatttacagctgttatggtttagcatttgctctgctacttgagataatggagagcaggttcttttaactcaagatacaatcgatcctgggagagcaaggagcaaggagacagcacttctagacacattccagagccatgaagcttggattctatccaagccacaagtgattatatgccctgggcttaggctatggcatgtcagggtagacttccaccctttagcacagagcttggtgttccaaaggccacaaggggttttagaccctggaccccggacatgttccaagactctttaacattatgtcagacatgcatgccctgcctcagcttctcccaacattcagcttttcccaacattcttcaatttcttgcatcagtgcttcatagtttttattgtagagttctttgaggtctttggttaagtttattctgagatattttatttcatttgaaactattgtaaatggaattacgttcttgatttgtttttcggttgttcgttgtctgtatatagaaatgctactgattggccaggtgtggtaactcgtgcttgtgatcccagcatgttgggaggccaaggtggcagatcacgagctcaggagatcaagaccaacctggataacacagtgaaacaccatctctgctaaaaatacaaaaaattagaaatcagccagtcatggtggcatgcaactgtagtctcaactactcaggaggctgaggcaggagaattgcttgaacccaggaggcagaggatgcagcgagccgagatcatgccattgtactccagcctgggtgacagagtgggactccatctcaaaaaaaaaaaaaaaaaaaaaagaaatgctactgattttgtggtatgttgattttgtatcccacaactttactgaatttatcagttctaacagatttttggtgaagtctttaggtttttccaaatataagaccataatatctgcaaacaaggataatttgacttctttctttccaatttggatgccttttattttgttttcttgtctgattgttctatctagaatttccagtactatgttgaatatcaggggaaaaagtgggcatccttgttgtgtttccaattatagaagaacgccttttagtttttcccattcattaatttactacctgtgagtttgtcatgtgtggcttttattatattgaagtctgtttcttctatatccacttttttaagggttttttttattatgaagggattttgaattttatcaaatggtttttcagcatcagttgaaatgattatatgacttttgtacttcattctgttattattatgtatcacattgattggtttgctaattaatgcattttagttttccccattcaataatttactacctgtgagtttgtcatatgtggcttttattatattgaggtctgttccttctataaccagttcttaaaggtttttatcatgaagggatgttgaattttatcaaatgctttttcagcatcagttgaaatgattatatgagttttgtccttcattctgttaatattatgtatcacattgtttgatttgtgtatgttgaatcattcttgcatccctgggataaaatgcacctggtcatggtgaatgatctttttaatatgttgttgaattcggtttgctagtatgttgttggggatttttgaagaaacattcatcagtaatatttgcatatagtttttttttctttttgatgtgtctttctctgtttttggtatcagggtatactcgcataatagaatgagtttgaaagtatttctatctcctctattttttagaatagtttaaatagcattggtattagttttttaaaaaaaagaaaaaaaaaactttggtagaattgagcagtgaagccatcaggtcctgggcttgtctttgctgggaaacttttttattacaactttaatttcattatttgttattggtctattcatgttttagatttcttcatggttcaatcttagtagattgtatgtgtctatgaatctatctatttcttccacaatttcaaatttactggcatatagttactcaaagtagccactaatgattctttgaatttctgtggtgtcaattgcaatgtctcctttttcatgtccaactttatttatttaggtcttctctttttttctcttagttattggataattgtttgtcatttttgtttatttctcaaaaacaaaaacccaaatttttattttattgatcttttgtattatttttgtttgtttcaatttcatttatctctactctgaactttattatttcctttcttctactaaattgggttcagtttgctcttgcttttctagttgtttaagatgcatcattaggttatgtacagtttttcttctttttttatgtatgtgcttatagctataaaattctatcttagtaatgcttttgctgtatcccacatgtttttgtatgttgtgcttgcattatcatttgcttcaataaatttttcaattttcttttaatttctttattaacccactggtaattcaggagagtattgtttaatttcctgtggttgtatagtttcaaaaattcctgttgtcattgatttctagttttgttcccttgtagtcagagaagatgtttgatactatttaacttttttgaatgttttaagacttgtgacctaacgtatggtgtctccttgagaatgatccatgtctgaggagaaaaatgtgtaatctacagctgttgaataaactgttccgtaaataactattaggttcattttgtgtatagtgcagatcaaatccaatgtatctttgttgatattctgtctgtaataactgtccagtgctgaaaatgaggtgttaaattctccagctattatttgtactgaggtctctctttagctctaataacaattgctttacatatctgggtgctccagtgttgggtgtatacatacttacaattgttatattctcttgctgaattgatccctttatcattatatggtgacttttttgtcttttattatagtttttgtcttgaaatctattttgtctgatataagtatagctactcctgttcttttgcagtttccattggcatgaaatatcttgtttcatctctttattttccatgtatatgtgtctttatagttgaagtatgtttcttgtagtcaacagattattggctcttttttttaaatgcattcagtcaccccactttttttcattgaggagtttagtttactaacattcagtattattattgataactaatgacttacccctgccattttgatatttgctttctggttgttttgtagtcttctcttccttctttccttccttcatgtcttccttttagtgaaggtgattttctctgactgtagaatttaatttcttgcttttaagtttttgtatatgtactgtgtgttttttgatttgaagttacaatgtagcttgtaaatactgctttgtaacccattattttaagctgacaaaaacttaacactgtttgaataaacaaacaagcaaaaagaaaactaataaaaattataccacttcttaacttcatctccccgttgtttaacttcttgttgtttctatttatatcttattttactgcttatgccttgaaaagttgttgtagttattatttttgattggttcaccttttagtctttctacttgagagtagtttacatatcacagttacaacattaaaatattctgtgtttttctgtgtacttattactatcagtgagttttgttccttgagattatttattattgctcattaaaattcatttttttttttttttttttttttgctgattgaagtactctcttttgcatttcttgtgggacaattctggtatttatgaaatcctttaacttttgtttttctgggaaagtatttctccttaaggtttgaaggatattttcactgaatatactgttctaggtcaaaaatttttttcttcagcattgaaatatgtcacaccgttcacttctggcctataaggttttcactgaaaagactgctgccagacatactggagctccaatgtatattatttgtttcttttctcttgatgcttttaggatcctttctttatctttgatctttaggtgtttgattattaaatgtcttgatgtagtcttctttggattaaagctatttgttttctataaccttcttgaacttggatattgatatatttctctacatttgagaacttccttgttatgattccattgaataaattttctacccagatatctttctctacctagtctttaaggccaataactcttaagtttgcccttttgagcttattttctagatcctatgagcatatttcattcttttttattccttttttatctctcttctgagtatattttcaagtagcctgtgttcaagctcactaattcttcattctgcttggtcaatctgctattaagagatgctaacacactcttcagtatgtcaattgcacttgtcagctccagaatttctgcttaattctttttaattatttccatgtatttgttaaatttatctgatagaattctggattctttctctgtgatatcttcaatttctttgagtttcctcaaccactattttgaattctctttatgaaaggtcacatatctcccagcactttgggaggccgaggtgggtggatcacaagatcaggaggttgagaccagcctgaccaacatggtgaaaccccatctctactaaaaatacaaaagttagccaggcatggtggcatgcacctgcatcccagctactcaggagtctgagacagaggcggaagttgcagtgagctgagatggtgccactgcactccagcctgggggacagagcaagactccatctcaaaaaaaaaaaagaaagaaagaaagaaagaaagaaagaaagaaagaaagaaaagtcacatatctctatttctccaggattgtttcctagtaccttatttactttgtgtggtgatgtcctgtttgtcctgagtgctcttttggaagttttctgtgtctgggcataagcgttaggtatttactgcagtctttgcagtccttcttctgaaggctttccaggtattagaaaggaatcagatgttgtggtctaagctatatctgcattgaggacacccgaagcccagtaacactgtggttcttgcagaatcatagaggtgccacctttatagtcttggatatgatttggaagaattctctggattaccaggcaaagactcttgttctcttcccttactttctcccaaacaaacagagtcactctctctgtgctgagctgcctggagctgatggtgaggtggcactgtccagtgaagctatgagtatgagaagagagtcactgtgctccagcccctagaattgtagctccaccaaaatcttgcaccatgtgcctggaaacgcttcaggcactcaatgccagcccatgaaagcaaccacagggctgacatggtttggccctctgacccagccaaatctcatcatgaattatactcctataattcccacgctttgtaggagggatgcagtagtagataatttgaatcacgggggtggttttccccatattgttcttgtggtagtgaataagtctcatgagatctgatggtttcatcaggggtttccgcttttgcatcttcctcattttctcctgctgccgccatgtaagaagtgccttttgccttctgccatgatttggaggcctccccaaacatgtggaactgtaagtccaattaaaactttttttcttcccagtcctagatatatctttatcagcagcatgaaaatggactaatacagtaaactggtaccagtagagcggggcattgctaaaaaggtaagcaaaaatgtggaagtaactttggaactgcgtaacaggtagagagtggaacaatttggagggctcaaaagaaagcaggaaaacgtgagaaagtttggaactttctagagacttgtggaatggcttttaccaaaagcctgatagcatatagacaataaggtccaggctgaggtggtctcagatagagatgaggaacttgctgggaactggagcaaagatgactcttgttatgttttagcaaagagactagcagcattttcccctgccctagatatctgtggaactttgaacttgagagagatgatgtggggtatctggcagaagaaatttctaagcagcaaagcattcatggtgtgacttgggtgctgttaagggcattcaattttataagagaagcagagcataaaatttcagaaaattttcagcctgacaatgtgatagaaaagaaaaacccattttctgactataatttaagctggctgcagaaatttgcaaaattaacaaggagccaaatgttaatcccgagacaatgggaaaaatgtctccagggcatgtcagaggtcttcacagcagcccctccctcccatcacaggcccagaggcctaggagggaaaatgattttatgggtcgtgcccagggtttccaagctgtgggcagcctgggactttgtgccctgcatcccagctgctccagcgatggctgaaaggggccaaggtagggctcaggccatggcttcagagggtgcaagccccaagccttggcagctgctacatgctgttgaacccataagggcacagaagtcaagaattaggttttgggaacctctacctagatttcagaagatgtatggatatgcctgggtacccaggcagaagtttgctgcacgggtggggtgctcatgaagaacctctgctagggcagtgcagaagagaaatgtggggttggagcccaaatacagagtccttactggggcatcacctagtgatgctgtaagaagaaggccaccatcctccacaccccagaatggtagatccctggacagcttgcacctatgcacttggaaaagccacagacatgcaacaccagcccatgacagcagctaggagggaggctgtaccctgaaaaaccacaggttggggagctgcccaagaccatggatacacatctggaaacacatctcttgcatcagcatgacctggatgtgagatctggagtcaaaggagatcactttggagctttaaaatttgactgccctgctggatttcagacttgcatgggccccataaccattttgttttggccaatttctttcatttggaatggatgtatttaccctatacctgtatctccattgtgtcttggaagtaactagcttgcttttggtttcacaggctcacaggtggaagggacgtgcttgtctcagatgagactttggactgtggacttttgggttaatgttgaaatgagttaagactttggtggactgttgggaaggcatgaatggtttctaaacctgagaatatgagatttggaggggccaggggcagaatgatatggtttggctttgtgttgtccccacccaaatctcatcttgaattgtactcccataattcccatgtgttgtgagagggatccattgggagataatttgaatcatggaggcagtttctgcaccctgttcttgtggtagtgaataagtctcatgagatccgatggtttcatcgggggtttctgcttttgaatcttccccattttctcttgctgccactatgtaagaagtgccttttgactttcaccatgattctgaggcctccccagatatgtggaaatgtacatcgaattaaatgtccttttcttcccagtcttgggtatgtccttatcagctgtgtgaaaacagactaatagaaaggctataccctgcacagactcagggacagagctgcctaaggcctggggatcccaccccttgcatcagtgtggcctggattcgagaaatggagtcaaaagagataattttggggctttaaatttaattactgcccttctggattttggacttgtatggggcctgcagccgctttcttttggttgatttctcccttttgaaatggaagtatttgcccaatacctgtacccccattgtatcttggaagtaactaatttgtttttgattttacaggctcattggtggaagggacttgtgttgtctcagatgagactctggattatgtacttttgagttaatgttgaaatgagttaagactttgggagactattgagaaggaatcattgtattttgcaatgtgagcaggtttgaatttgtgtccacacccaaatctcaattcaaattataatccccaatgttggaggcagggcttggtgggaggtgattgaatcatggggtcgcaattccccctttggtgctgttcttgtgatagagttctctcagatgatatagtttaaaagtgtgtagcatctcccgcctctccctcttcctcctgctctggccatgtgagacatgcatgcttcccctttaccttctactataattgtaagtttccttacgcctccctggctatgcttcctgtatagcatgtggaactgcgaaccaattaaacctcttttttaaataaattattgatatagcttggctatatcactacccaaatcacatctcttactgtaatctgaattctaatcccacatgttgaggaagggttcttctgggaggtgattggatcatgggggcagttttccccatgacgttctcctaatagtgagtgagttctcatgagatctggttgtttgataagtgtctggcaatttcccctgcgctccctctctcatctgctgccatgtaaggtgtgccttgcttcccctttgcattctaccatgattataagttttctgaggcctccacagccacacagaactgtgagtcaactaaacatcttttctttataaattacccagtctctggtagtatctgtatagcactgtgagaacaaactaatacaaaggtttagcctgaaggtaagggctatggaactagtcaaaaaaagaaaattaaaaaattaagagacttaaactactcctaataggaaattttgggaaatttcaatgagctataaagcaaagaagaatatagaaagggacaaagacaaaggatggtggtggggtgggaggataggtacatggccaggaagcttgtgggttgaaaggctaaaaggaaactgccctatgacaaatggccacatgattttataagaaaaaataagctaatttatttttcctttctctctctctctctctctctgcctcactctctgtttcatgcttgctctctctctctctctgattaaaccactttcctttcttatccatcaggtgcaacttcattagagccagaatgcccctcaacattgcttcaccagtctacccttccaccaacaatatataaaagttcctgaatctccacattcttagcatctcctggcattctttagctgtctgtgacatgctatcctaacataacatagcctaacacttacatgacaatacgtacataatcacagtatgaggaaattaatggagaagttcaattatgggccctaccacaatacataaaacagagatagtattcatagaagaaaacctgacacaaaagtaagagaaaaaatatcccagcatatctgggaaaatcttgaggatggatgtggatctccccatgatacagaatttgaagttttaagtcaatttttaaacaaggaggagaataatgttaccagattatatctggttggcacagtttaaaaaaagacatacggtatctgtttcttgatgaaaacaatgtgcaagttacaattactttttatgaaaaaaatgaaattagtacctgcatattgaagaatggaaatgaaatgaaaaggttcaagataaatgaatgcaattttaaattttgattgtaatagttcttattgtgtgttattgtttaatctcatacgggcagctattttcataacacatatacctgcataatttaatatattttaaggcaatgtgtatatgtgaaaattaaggacaactaaaaatgcttatgactgaaatttctatttcaattggcctattcatgacaatgtctttccattgattttggactattaaggttaatacccagtattcttatcataaaaaggaaaaatcaaggaatattatgaacaatttggaagttattttatatcattttttaaaatttgtcattatattgatccttctctgatgcctaaattctggcaactcctttgagatatcattgctattataaagcctacgctacatctgttaataagttcccagtagaaaaatacagaatctcattcaaaagtatctagtcatgaattcatgctatttctgaaagttgactttttaacagaggtatcaatattaaaattcttttctttagactagcctgtgtgttataaagaaaagaaaacacacttcctctgacaatataaacaattcctggtaaataacttgaagacatataccatataacttcaggctgcatatttaaaatacactttaacaaagcacaatataaattcttcttaaggccttcattaatcaatagaggatgacactgtatccatcatgcaagaaaactgggaatataggaaaaacaaaacaaaactccttttctgctttttagttccttagtgtatgaagactgaaacataatcaatattatgtatcaatgtttgggagaaatgtgttactgtgttggtctacattttaactttaattgttttgttatttagtatgacaacaggaaacagaaaagacagataatgatggggacaataatagaaattgatatgaattggaactttgctaaataatatagcctgtatctacataaaatatatttcttttcaaaatatttatttagtaattgtccttaaaagttataaaggttttaagttaaaaatatcttatgcaaacttgggtctcagttctgctttgtctcacttaaaatttataccattcagaaaatttcttaaaatctctggacatcatttgcttcattagtacactgagaagtcaggacttataaagagaatgcttagtaatatgttaggacgtaaaattctataaatgaaaataaaattcttcttaggacaacttaatgtttattaggacatttatcatataaataattggagcttattgtgtgccagcttgtattggtgaggcttcattcctttattcgctccttcaattattcttgtatttttaatgcatttattcagtgcctggaaggtatgatgctctatgctaagctttagaaacacgggagtgaacaaaaaatttacagttacgtagagtctgctgaaaaatttgctaacctttggcttgtgaactctttagggtttcattattaatacattgcaaggaattattttgttaaaggtacaactatcccaggctaaaaatgtcttttgttggcaatacagtaatttacaaatattctctattatgaaactgtttaagaacctctgatcatgtatcgtgtaagatgatgtaaatataagaacagaccagcttgttcatgatttcataatttgatatgtttggctcttattaacaggtatttatttctgtataagagaatcattgattttctgttgtctttttttattgtggcagcaagagataacatgggatctactctgttaacaaattttgaagtatagagcaccttattgcttattacaagcacgatgttgtacatcgaatctccagaactaattcatcttgcataactgaaattttatacatgtttattaccaactcctcattttcctgtctcctcagggcctaccattctgttctttgtttctataaatttggctattttacatacatcatataaataaaatcgtgcagtatttgtcctcctgtgactggcttatttcatttaatgtattcattcatttttgcactactatggagaaataccctaagctgggtaatttataaaggaaagaagtttaattgactcatagttccgcatggctggggagacctcaggaaacttacaatcatagcagaaggagaaacaaacacatccttcttcacatggttgcaggagtgagaagaatgggagctgagagaagggagaagcccttatgaaaccatcagatcttgtaaaaactcactcactgtcattctccactgcaggagaatggtgtgaacccaggaggtggagcttacagtgagctgagattgtgccactgcactccagcctgggcaacagagcaagactccatctcaaaaaaaaaaaaaaaaaaatccgggacctgatgtcttcactgctgaattctaccaatcttttaaaaattatcaatccttcccaaactcttccaaaaatgtgaagacgaagaaattctccaaaattactttttgagattagtattatcctgctagcaaagccaaataaagacaatatgggaaaagaaaaatacaggttaatatctctggtaataacagatgcaaaaattttcaataaagtaatagaaaatataattcgctagtacattgaaaagatcatacatctagatcaaatgggatttatccctgggacgtaaagatagttcaacttagaaaaatcaattaaggtgatatatcacattaacaaaatgaaaaatgaaaactacaggattatctcagtagatacagaaaaagcattagagaaaatttaacaccttttcatgataaaatctctcaataaactagaaacataaggaatgtacttcaaaataataaaggccatatatgacaagcgtagagttagtagcatactcaatgatactcaatggtgaaaaattgaaaaatttttctgtaaggtgaggaacaagcctaagttgcttacttttgacacttctatataaaagacatacaagtcagaaagacttgtttgcagatgagatgatcattgatttatatgtaattttttctcagccacattagctatttattatctattgtatattatttgtgtacaaaactgatgtacagataaaccagaaatgaatcatatatgacagtaatgttgaactacaagttaatgtaaaaaaactgtgttataactattaaatatattgtcttaacatttgaaggtacgtaacctccatttgcctaatcaatacatttatgtagtaaattaatgtttcaaaaactttgaaaatcattaagtgagaaaatatagtaactaacatattcaataagactttttatttattataaatatttctacattataaaattttatgtcttaagaaaaccttgcaaatagaagtcatacatttgtttttcgactgcaacatttacaaataaaatggaaattatatgaacaatcaagttgatagatttataaagtagaaaatgaagaaaaatccaaaagttagttcataaaggaagttcgctcaatttccagtgctgcaatatgttgtacatttccatgcaaactttaaaatatttctagtttccaggagaattatcatgcattatattaccttaatgtattcttgaaacttatgtaaattatgaacagtgaatatttttccaaagaagaagttaaaaactatgtctattaaaaaccaaattcttcccatatgatattccaattttctcatcataaattatgaagtaatcaatcttttctttacactggctttaagtatatgattatgagtatacgttatctcagaattttgtgtatttgtagaattttgagtttgttctttaaatctatgcattgttatcttatactttaatatctagtgggcataatctcccctgcctgcccattattactctgtgttttagaaatttctcagcagatcatgttgatttactctttcctatgacctttcatctgttgcatcttcttcatgcctaatgctatttttatttttgagatttttcattatatttatggattacatagagagaagtagcattttgttattttgaatcttgctatacagaacatggtatttgttatatttgtttatgccatatttaggtattttagtaatattttaaatatttcttcatatatatcaagcttatctcatgttatgtttctatctagaaattttttcagcattgaattttgtaaatgggcttttaaaaatatattttctttctgtttatggatttttatatgagaagtctaaaaatttctgtaggctaatttagaacttctgagtgttattacgaataaaattgttcccttatttttctttttagaaaagattgcttgactataattttgcagatctatttctgggttctctattctgttccactaatctatgtgtctcttgttctaccaatgccacatcatgttaattacgatagccttaattactaagcttgagatcaggtagtgtgagtcctttagtatttttcttcttcttcaatactgtgttgggtaatctaggtactgttttactttccacatatacattagaattagtttactgatattctcatacagctttctaggattttgatttggattatattgaatctattgataaatttgtgtggaacaaatatctcaacaatattgaggttctcaggcaatgtatatggaatatttctccctttacttagatcttctctggttttttgcatcattgttttatagtttcctgcatacagtttctttattcatatattttcatatcatttctacatatacaggcaaattttatatcattactactcttgtttgtaactgtatttattttggtatttttcctacagggatagatttaatagtcaccattgggctttttggtaaaaccacatgagtaattttctgcttgattcaacatcagtatttagtactttttgaaagaagggcttatgggaactagttgttacaagttataatgaagtttctgctaccatttttcttgaacaatagtttgtttactataaaatttcttggaaaaacatctcattgtgtcactatttcttgtcatttgatattataatggagaagtgggatatgaactcacattttctgttatagatgactataataatttgcctctctccatcaataattactcatttatattagattttcattacctttaacaaaatataactccatgttgattattctatgccaaaatcttctttatctctttggagaagatatgtccatttaatctgcatgcgtaaatataaatttttactttctggattttttgtctcttaaatattatattttttcatctattgttttaattttgttccctcaggagcaccaaccaagtaaaagaagttggatctcctttcctgtcttccacttcaactatttcactaagaatttatctaacactttattacttttcatttcctttctctaactactcttcatcatacaattttatgtttcttattatattaacggtgttattttgtacagctttcatatttacctaaattctataatcactttttacctttttttcacttctgagatctaccagtttacttttgatcttttcttttcttttctttttttttttttttttttgagacaaagtctctctctgtcacccaggccggagtgcattggcgcaatctcggctcactgcaagctccgccttccgggttcacgccattctcctgcctcagcctctcaagtagctgggactacaggcgcccgccaccaatgccgggctaattttttgtatttttagtagagacgaggtttcactgtgctagccaggatggtctcgatctcctgaccttgtcatctgcccacctcggcctcccaaagtgttgggattacaggcgtgagccaccccgcctggcctgatcttttattgtcttataggaaaagtcaagtgatacaaagtagccactcattctcattgccagtactttctttgcccctgtaactactttcttcccatagtacccaccatcactggacatgtcatatattcactcaacttatttattgcttatctcatttcattaaaatattagctccataggagacagatacaatctcttttgtttgttatcatgttcctttagcctagaatggtgtcagaaatagaatcgatgctcaacaattagtttgcactgaatagataaacaaatacaatggatagtgagtgaatgataaatttacagtagaaaatttaggaaactattatttcaaagactgtgggggaaagacgattctttcaaatactctgcataaataaagagcatgcaagcttcacacatcgaagttctttgtattaagttccagataaattctatgattatgctaaaatactatcctaactctttcaaccatacagctaacaaaaaattcaaatttcaatctgttgtcaaattttaatatcacttaaattcattatctttctagacttcctgtctaaacatttgggaattgattgaaaaaacagtggggcggcggggggggaatatgaaggtttagatttatttgttcattcagtgagccttaattgagtgtttattatgtgctacaccctattctagatgctgaagaaaacatagctcctactttcatgaaatatagcttataacagtctcccctgctagcagaattattccttcctctcctttttgaagatcctttaacaaacttttctaacaaaataaacttgcaataggaaagccatgttactgaagccacatcttcactgtctgttaaaccagattagagagcatgctctgtggatcaattacaatgttaaacctgggaactgaagaggtgcacacaggagtgtagaattgttgtaaaatttataatttagaaaaaatgaggagaaatatatctgtgaatgtcttatgaaaactgtagaaaattagggttgaacatgattgtagtttggttgagtttgagcatgagtgcgttggcagatactctgcatccggtgtgctaggtcaagcagacgggaatctttatcatcgctcttcttgattagttgacacatttgggatcagtagtgggccatggaaactaaaattaatatgccagtaattcctaattataatgtattttaaaaatataaaaatgtagagaaataaaaaatttgagtagaattatcaggtttaagacactcactatgaactatgtcctctgaaggaccaagaggtcaatttattcaccaaatctttaagaaatctaccaaagaggatcctcgtggtctttaaaaattatttattgattaattattccctgtagggggatacttcagttaagtaatctttctgatttctactgaaatccaggatccccaggatagcaaaggctgagaaaatatttcataaaacattacaggtatggtctataaacttgcttctcgagtgccttagatggaactgctgccatatttttttagagtaagtacgtactagacaatcagaatactcaaacgttaacatgacagaaaatattagaaactggctctgaggtaatcatgaactccaagcaaactgaaaacctctgtggttcactgctcagagtagagctcactttgtcaggtgatacatattattccctgggactcttttaatcccacctaaaattattttcttggtctttaaatatatatttataacagcacctgacagaattctcatatcagttttaatccttgtatgatcattagagtaagagaggccaaaccaaagcatctttcttttaaaataataaatcaaagtcaatactctcacgtggagaatcagagattagtgttaccatttaagacataaaatatgactccctgtttttactctgaagaagtaagttggctgtgagggaaatataatagggtaacataagacatatgaatcagcaattccaaatttaatgatgttttttcctgatatgtcttctttgctagagtaaatcaacacagccctagaatttgataaacaaccaccaagctgtcaaatgtgtggtattttcccccttactccgatgattagagaatactggaagcagaaggccaagagaaccatatgtgtgtttccatctcattgaggtttagccaacctttggctccatgacacaaactaaaataaaagggctttaattgtctagcattccacaagctgttatggcatactttttaaaatatgtcttcctgcctctatgactaaaactatctattggaggaacaaggtaggagattaattccataaaaattagatttctgttatttcagtaaaatttctgttggtctagtgttctgaggaatgtcaaatcatcattaccaaaatgaatgaagtaacatgattctttaaatccacatttgttgtactgatctgaccattctgcattgaatggaagcaaattaaagaaggatttctgtagtgcaagcaactgttcttaaggtaatccagaggcaattatattactgatgctgcccttggtgaaataaatctggcaaacaggacttcatcaagtggaagtaacatatgtaatattggccttaaacagatcccaaaggtacaaatattttcatgagtggtttgctgactctttcagcactctgacattggttgtgctaccacattcttctcaatctatgccggtggcctctgcggaatttccccatcacgagttgactgaaaagaaaaatccaagccagataataggtagctctaaaattacaggatggaactaacccaaagtgacagctatggcatcataaccctctcaggaatagtccaaaagaagaatgaagcaggaaagtcatcccagaattacctttgcagtagctcatattgtttacttttccagaaattattttagatctaaagtaaatatctacttttattcagagtaatgactaaagttgtagttcactgttaaggtgctcaatgaaataagattcggaagattggtagtaagaaagtttggggcaagggtatatagatggattgcttagagtttttccaaaatcagacaataattgtgtatcattaagagacctttatggttgtgaagtcattcaatataaaagatgcagataatgttccaccctgggattgtcaccatctcttacccttcctctcctctcccacttttactatatcaattcattaacagataggcaacgctttcaagatggaacaaagaatgaactcacagatatggaattaccctcaccaaaagtgataaggctatactgctgttggataaaaattgccagactgctaagcacttcaggctcaagaatagtatcttacaacatcctcttacagcagagcaaacacgtcacagcaggttgataatgtttggagtagttgtcatttgaaacacagttatttgggatttgggtttctttctacttactgtcaattccagcgtgcttgggcttgttcgatgccttacacaatatcacgaggaactataatggcaatgctttcatgcaaataattcattttacaaccacatatttaatatcatggtttgaaatccatggcattactggtggataactttaaattcaggttgtctgagacatttctggattagacaaaattgtgttatatatttattgtcttcatttttttctcagaatctttaaaaatgtttctatctgtatgataaataactttttaaaaactcatctctttcattggacttattttttctttatttctttattttttttgagacagagtctccctctgttgccaggctggagtgcagtggcccaatctcggctcactgcaatctacgcctccctggttcaagcaattctcctgccccagcctcccgagtaattgggattacaggcacgtgccaccatgcccagataatttttgtatttttagtagagaaggggtttcaccatgttggtcaggatggtctcaatctcctgacctcacgatctgcccacctcggcctcccaaagtgctgggatcacaggcgtgagccaccactcctggccctcattggggttattgtactccccatcacattgtaatgatgttcctgtaatatagaataacatcttgaaaatttaataataaagtctgctgggtgaaaacatatttagggttgaggacgtctacatatggattagcaaacgatgttggtgattctgcttagtcagaaggtagaattaaaaaacaaaaacaaaacaataaatggaaaaaggaattagctctttcactgttgtatttgaagattccctaataaattttttttaaactggtctactgggttaatctggcttagaatttctgttgtccaagtgagaaattctttattgatgtatgtatattgattcctttgatagaaaaataagatatttactgaactagcaagcaacaaatgttctctgaatgggtgtaatggactaatcttaactatcaaagttaacagtgatactgacaactttagtttcaaaaagaaagggtactaaaatttagagaattttctagggcacattcttatgattcctctaggaagagtcaaaatatcaagggctcagatcactcaggaatcaaatattggcctattttcagtagggtgacaacctactgaatttgaatatattccagagtggtttttttttaaattcctgaagcaaggtaaataactataattcacttttgctaatcaaattatccttctaataatgatagtgagggtgatgacgataggtcggtaacattcatctacctctttaaaatatgccagacactgtcccaagtgcatttcaatgactaatttaatcctacattttaaaagtatatactattattaagaaatatattgttagtataagtaaatgttaaagatggtttttataacctccccaaatgtgactttttctgctatgcgacagaacaagcctttttatctaagtgaaatagaggtaaatttaagtactagaaaggaataaagatagagttaggggaagctgaaagctaactgttcattcttgtccattttgtccaaaggcaaccatattgaaatcttcaaagatgctatcctcgctctcactcttttaactttattttctgttagcttttcagttctataatttttatactggtcagaacttttctgagtgatggctgggaatagaatgccggcttcctatcaacaaacacttaccaacttccagcagatgttgcaaaaagattcactgatttgtgctacaatcagcagggcaattgtttcattttgactctctatgaaatccaatgtatccattttagtttgactgacagacatggatttctcttctggtgaaatttttttgtaccattcgaaatgcaagcctgatggacaatgctttcacaaaagatgataaatcattttttttttatctttctctctctaaaaattgaaagcagcaatggctcgtgaatatttacgtaaaattcaagggatatgcattcttacctaaatttggattcacaggaaaaatatatagtctatgcatataaatccgttttagtcattttagtttacaaagccttctccatataactgtcatacttagtaatatccagtgaaaaaaaatgtagtgatttctttgaaaatgtcaaatctgctaaatatcagaaaggctttctgtatataaatatgaaactgcctatataaagcaatacaaggaccctcaacatttgaaatttgttaacaatttattctggttttattttctctttttgaatattatacaaacaactttttttgacccatgctttgtcagtacttagtaacgtatgcttcctgaaagtaaatatatcatagagtaaaatacattttgatgatactagaaaaattatagaaattagctgcgagcatgcacatttatataagtagtattttgaaagtagtcattaggctatacaaacacttcttccaaaatcatttttatgaatatagtcagttttggcacacttccttttagacatccctggaagagtttttacagtattctgtgttgactatcttcatcattgtcagaacttaggaagatttattttttaatagagtaatctagatgaataacacccatgttatcaaatgaagaagtcataaaaactattaagattgataatcttatgtgtgccatgaactgattccaaatgagcttcaaaatgaaggtgacatattgaaaaaaaaaaaggttgtcttactctttcaagaaacataatttgaagaggccagttacttaaatatatacattttggtatgctaacaaattaatctcattaatatacactcaagtttttggaagatgatgagctatatgagaatgatcagtagtggaatacttacttccaaactccagaaatttctcattgaaaacgtttatttatatatttttttgaattttatttcagtagtttttggtgaacaggtggtttctggtcacatgaatacgttcttttgtagtgatttctgagattttgttgcacctatcacccaagcactgtatattgtaaccaatgtgtagtcttttatccatcatccccctcccacacctctcctgcccaccctccaagtccccaaagtcccttatataattcatacgcttttgcatcctcatagcttagctcccacttacaagtgagaacatacgatatttggtttcccattcctgagttacttcacatgatacaaaaaactgacaggtgttttagttagaatatcaagagaaaaggattgttatttcattcacttgtcagagcaatacaaccaatagggttttaacagaaaacaaataatatagtaaacataagtaattaaaatagttcataatttttttcaggaatcagagaaaccaacaagggatggtaaagcatctcagtgctagcaagtaagatgttattccggaaaggaaaatgtgtggaagtattagtttgctagcaatgccataacaaattaccacagactcagtggctagaacaacagaattattttctcatgattctggaggctggaagtccacaatcaaggtgtcagcagggttggtttcatttgaaggttctctccttggcttatagatactgtcttctccaagtgtcttcacatggtattgtcctctgtgtgtgactctgtcttaatctcctcttcttataaggacaccagtcatgttagactagaacccacctcaataacctcatttaacctgaattacttctttaaagatgctatctccaaacactgtcaccttctgaggtactgggagttaggacttcaacacaggagggggaagagatgtacacagttcagtccatcacagggagtaatcactggaagctacagacagctaaaactataggagaaaattgcctcctgggagccttgtgtagaggatacagccactgccaatgtgttttactctctctttcttttattttctagctgaagtgaaacagaagttataagggtttctaatcaacacagttcatgaatgtcatactcccagggaacagaacaaggtggaaaggggtaaggagtagctatggagagacagcccatttactacagtccacctctttaccctttgtcatttgcatgaaaaactctttctttccatcacagaaaaaatcacgagtttccatcagccatggtattattaagagtgattttaatgcagttatattctcacttgaaaatagacatacactccaaataatgtatatgagcaaatagggattataaaaagaaattttaattcacttaaaacacagctacatagcacttcttcaagtgctagcatagcacttcttaaattgtcctgagatttaagctgctaatcatagcttccttcttacagcattcttgtcattttccttccactacatctgccagcatgttggttagatggagttcttctggtgcagtcatggaaatcatcctttcttcaactttaaaatctttgatggcctgcgattattgagtttttaatgggaataattttagcttcacagaaaagatttacaggtagtacagagagatccaatatacacctcacctattttcctctaatgttatcatcttacatactatggcacatgtgtcaaaactgaaaattaatgaatagtattaactaaacttgagggtttatttggatctcactagttttttttttactaatgtctcttttctgttccagaatccaatcagaaatggtacatggtgtttgcatgtgatttctatgtgttctaaatttctactcttcaatgacaaatgttaagcatttccttggttttttttttaatgattttgacagtttttagaagctgtggaaatactctcattttgggtatatatatgtgtattttttcccattgctgcactgggttatagattttgaggaagacggtcataagagtgaagtgcccttcttactatattgtgtcaaggactagaatacgtcaaaatgctttatcactgattatgtcgaccttgataatttgcagtgtttgtgtggtttcccattgtgagttactatttttctcatttccatattctattttttgaagcaagtcactaattccagctcattcttacggaggggcagataaactccaactcttggaagggggagaaacacatcaatatatcatttgaaaagattttgtaaatgagtttcgctcatcttcatgtatttatatattaaatcatttatttgtgtgaatataaagtgatcgatttttttttactttggattacaattctaacactacattctctaccatgttgttcaaattatttcaaattttgatctctgtgtgctctttcagattgacccctctgtccctttgatgtattcgttttattttgtgaacacgtccatattttatagcactacatgatgctctaggctcagcttgcatttttttctgtcctggatcaagaatctggtattttttgaagatacttagtggataaagatagatagaaaccaaaagcttggctctgtgtgtgcttacgaccactgtagtctcactgcttctagggctcttagtatgcagagctacctttacacacacacacacacacacacacacacaatacctatatttgtgtagataatatatgacttccgtatacatttatctctctctccttgtgtgcatgtgtacgtgtggggagggagtgaacacgagttcatactgatgtctccaactctaatccagtactgcaagtttcatttttgtctttcatacggctgcttgtgacttctttctctgagactgagaaacatgaatctccttttctaccatctgtttatctttttttttccatccaaccaactctacaggtaaattagtttcacaattgtgaatccacttgattgtgagaaacaaaatgtcaaacagctgtggaatgtttaggtatatttttatttttattttgttttaaatccttagccttgaaatttccagtcaaaacattgttttctaaaggtactttggtcagcttgcttttttttttcataatttcagtgagatttgtcatatttttgtaataatactagattcacttgttatagtctctatttcatcaaaaaaaaatcccccaactttccgtattttttaaatttacatgcattaaatttcacctgttatcttttacagttctgtgggttttagcaaaatcagactagtgtgtctacatagtagtgccacacagaagagttttatcactctaaaaagtccctgttcccctcctcttattcaataaatctatgttctcttaagccacaaaaataataaaataatattcttttctatttctttagttttaaatttctagaattccatatgagttgtatcataaaatatgtgacttttaattcttccttctttcacctagtaaagtgcatttaagatccattcatgtggtgggtgcatatgcatgactcaacagctcatttctttgatcactgaatagtgtttcatggaatggggtgtgtatttatccctctgttgaaggtcatagtttctcaaagatgggcaactgaaggagcagaaacttgttccacacttttgagaaagacatactcctgacatgacttaccagggtggagagttcgtgtcccacaaagatagcattcagtagagaattctaaagtattgtaacttagtggtaaaaataaatatattgtaacataatggctaatctaaaccacctttacaaagctaaacatgttcatcaatataaacatacacagaaataacacagataatgaattactactaaaggaatttaagacagttatggcaaatatgttcaatatgttcaaatattcaacatgttcttcagaatgcaagagaattatattgtaaatagagaaccaaatgagatgagatcctttagagataaaattgactatatctgaaatgaaaatatgattgacagcaattagggactaaagcctaataaattagggaactcatagaacatgcaatagaaacagttaaaacttcaacatagagaaaacaaacagtttttttaaaagtagtaactcagttacttgtaggatgatatcaagcaatacaccgtacctataattgacatcccaaaaaattggcacagaagagggacagaaaacaatattttagtataatgaccgaactctttctaaatgtgattaaaagtaggaactaagagttgaatttttttaaataaaaaaggaagcaaaacacaaaacaaaacaagaagaaataaaattatccaagtaagataaacataaaagaaatgcaattctatggtggcacaacatactcatattgcttagaagagtgataaagagataaccttaaaagcatccagagataccgaaatgtttgcaaaggaataagtattactgaaaactgttgactaagcaaatattaaagatgtttttctgacaacaaataattgaaaatttaaagcaaaaaataatagtttgctaaggccaggcttattgagcacattgagcctggccttagctctgtgtgtgtatgtgtgtgtgtgtgtgtgtgtgtgtgtgtgtgtgtgtgtgtaaaacatatgatcacaataatgcaaacactgggagaaggaaatgcaagcataccttaatacaattcctctcctatagatgacataatgtagtatcactttgaatatagaacaggattccttaatctcagcactattgatatttaggaccaaacaaaaactttcttggtgtgggaggttgttgtcccatgtattgaaagaaatttagctacatacctagtttctaccaactacatgccatcctccaggttgtgacaaccaaaagtatctccagatattcccaatgacttattgtggagaaatactggcctccaggtagtattatacacaatggtgaatactaaatgcttttccctaatttccagaacagcagaaggatatctgctttcatcaatattttactaaaggctttagccatagcaatgaggcaagcattttttttaaagactttcagtttagaaatgaagaagtaataaggtcttatgtgcagatggtatgattacacagaaaatacaattgaatctatgaaatagctactggaaataatagatcagtttataaagttttcaaataagattaatataaacaaacaattgtattttcatatactaccaaacagattgaaataaaataacaatcaccaaaaaatacaaatttggaaaacatttgaagataaatctgacaaaacatacgtaagatctgttcagataaaactgaaaaaagattctgcaagaaattaaaaacctatataagtagaaaaatatattatttcacagagctgaaaaactcatccttaagatgcccattgtcccaaaatcccaggagacttttttttgtagaaattaacaagctgtttaaaaaattcattttgtaatacaaaggacccaaatatccaagtaactgtgagatggaacaaaattggtaggccaaaactacatgatttcaaaatgctacaataattaagacagtgcattcaataatacaccaaacacagacacagacaaatagatcaatggaggagaactcatcaatgaagatcacatagatcaatggagtagaatcacaattccagaaatggaaccatgcatatgtggacaactggttttcaatgaaagtacaaacatagttcaatagaaaaggaagagtctcttcaaggaatgatggtaatcggatacacatataaacaagaaaacccaatttatagctcataccataaacaacaggaactgaagatgaaccactgacctaaaactataaaattttaaaacaaaatacaggcaaaaatatttgcaatcttaggtaaagccagatttcttagaattgataccacaagcctgaaccataaaatacaaaaatgataaatttgatttctttgaaattaaaagtggctgttctttaaaaatcactgctaaaggaatgaaaaagacaagccaaagactgggagaaaatatttgcaaagctagtatcagataaagaaattgtacatagaatatataaagtactccccaaaatcaattttaaggaaacaaacagtccaatatgtattgtgaaaatgatttaaccatacataacaccaagtaaaatatatggtaaacaaataggaacatgaaagatgttcaatctaatcagttattaggtaagtggaaattaagtgaaaatgaaacaacaccaatatctattagaatggttaagatttaaaagactggcaatcatctctactaaaaaacacaaaattagctgggtgtggaggcgcatgtctgtaattgcagctacttgggaggctgaggaagaagaatcacttgaacccgggaggtggaggttgaggtgagctgagatcacgccatttcaccagcctgtgcaacaagagtgaaactcggtctcaaaaaaaaaaaagactagcaatgacaagttttagagagtatcttaaggaacttgtaatcccatacaatgctggtggatatgcaaaatgtaacattcatcttgaaaatgttttcattttctttaaaagttaagtatttatctctcatgtgatatagtcattctactcctaaatatttatccaagataaaatatttgaacatgagtttttatagaaactttatttataaatagagaaaaactgaaaataacttgagtctatcaactggtggttgggtaaaaggaatcatggtatgttcatatattgacatactattgagcattcatataatggcactatatagagacataaaaagtattgaaatactgagatttgcagcaaaacgaatgaagctcaaagtaagtatgctgggtaaaagatggcagacataacgagtacatgacatatgtaagtttttaataaaatagagaaataaaggaataaaaaatcaaaaaactaaaaatctctggaatatacaaaggaatccataggacaaagggttaatcaatggttgtctgaatggggagaagtgaaaaggagaaggaatgaggaattataatgagagagtggaaactctttgtagtaacagatatgcatagttatgattggggtgatgatgtcattgggtgtgtatgtatatgagaacagcaattgtacactttaaatatacatgtttatctttggtcagttatacataaacaaagctattgaaatttaaagtattaacctgcatgtcaaaacctatgattgtgaaaattatcagcgcacacctataagaacaccttggtgatatcaattaggcaacaatttcctagatgtgatatcaacagactcacaacagatagtagcagataaatagccaacatcaaagggaggaacatcatttcttcaaaagataccctgaagtgaataaaaagagaattcacatactagggggaaatatttgcaaatgcatatgacaaagaacttttccaatctttatatccaaaatatttttaaaaccctgaaaactcaataataaggagatagataccccaatttataagtggtcaaaagatttgagccgccttcaccacagaagatgcatgaatcaaataagaaactgcaattttgctcaataccattgatcactgaagaaatgcaaattaaaattccaataggtaagtcctacatgggcctatgagaatatttaaaattaaaaaggttgatcatagcattgctagtgagtgtgtggagcaagtagcaatatcatacatggcttctgggaataaaagtgttatgatcaccttgaaaaacagtttcataaaaaggtatacatatgcctaccatttgtcctagccatgacacagttaaatgttcacccaggaaaaccaaaagcatgtatttgtagattcttaggcatgaatgtgtagcagctttctttgtaatagccaaaccttggacactgcttgaatatccatcaccagataaatagacaaataagttgtgatatattcatacaatggaatactacttggctgtcaaagaatgaactgttgattcaggaaccaacaaagatgaacttcaaaataatttgctgcatgaaggaagccaaacaataaagaatatgtactctatgattatatttatacatggttctataaaatgtaccctcattttgctgacagaaagtatagtacttggttgaggacagagatatgagaaaagcaatgtgcaggaggaaagaattacaatatttcaagaggaaacttggcagtgagtgataagctcattatcttaactgcaacaatgattttatgcatctatacatatatgcaaacttagaaactagacacttaaaatatgtgctatttactgacaactaatccaataaaactattaaaatgtacatgttattagggctccttaatttttatctcttatcctaatctcaccttgaactaaaaatttacatatccaactttctacctgatatctcctctaggagttcccacaggaatctctaatttcgaatatacagagcttgatattcttttttttccaaattttcatctcttgttatactgaaactcttcatcagtggtaaatccatttttctaatttcttagctcaaaatccttacaatcatttttataattcttttatcctctcatatcctacatcaaatctctcagcatatcttgtgtcatctgtcttcaaattacatctaggggcaactactcctcaacaccttcactgttcgcactatagtccaaaccaatctgtcatatcaaccccctacaatgtccctttaactgtcaaaatgtcttccagtattattcccctctagagcagccaggtggacccttgtaatacattaacataactgtgtcacattgtcagctcctcccgtgtcttgctatcctgctcataacaaaatcaaaaatccttttcttagtttacaagattctacaaaatctagtagccttactctcacctatcaatcaatctgcttcaaccacctcggagtacgctcttgcctcagacatttgcactgcatggatgctctttctggaatgtcctctactgaaatattcacaaggtgcattctatcccttcattcacatctctgcccaaaatgcatatccttggagaagctatcatttctgtagcagcaccacctcaccacattcattgtcttcatagcatgtatcattacatccaattttacagcaggtgtgtttgtaaattgtttgtacctcccgtgcaaatatattcttaagagcaccaacttggtcctcttttatttatctactgctctttaatatatttggtgattgataggaatcagttgctttactaaatgaatcagtcaatatatacagcgttcgcactggcaatctcaaaaagctgagaattacaaatctagactttagagtcagctcatctatatgcttctcaaatgttaactgtaaactgcaaaacactgaggctcctacatcattcagattaattcttctacgctgttaaaatattaagtagtaccagaaatttgatcaattctggcagaaaagaaatggcaacaatgacgtataatgtggcttaaccaaattgaatgtttgactatcacaacaagaaaccgtttatgtattagtgccttatgtattttcacatagtgttagcagcatacgtacatgatattcattggctttgcatctccattgttactaacattgtttccctacttgcagcaaccctttgaatttcttaacttttcacgttgcttttgtagttgacagatatagatgagtgatgttgggttttactgaacacatgtttcatttcatattcaacgttttaatcattaggttgtgtatacattaattatgtttgtttctaaacattgaaatttagcaaatcatgtgcacaaagataacattaatacttaaatgtccaaatgttcatgcagttaattaagattttgttttaaatttacttaaaataaagcaagccatcaacagatttttttcctaaaataatgcttgtatctatattctgatctcaacacagaactttagataatgattctgtcattccaataaattaccttaccttatcctgaaaaatgataggtttaacaaggtgatcactatggtatgattcagctgtcattttaaaacatatccttggttagaaatttttctaaaaaataatatataactatgtaattctaatattttattgttactgttttataatttaaattgcatatagattgacatctaatatacatttatacgtctacatatctctatatagatacatatttttttctaacatgcacctgaattatagttgacattaaaagataattagtaataataagttccaggactagcaaaatgttttttattcaccataaaatgttctttccaattgcaacttatagtttttttgtatttaattattcctaattaattaactgtatttaattattacaatcatcaagactctcagtagcttacttagcacattttggggaaagtactattggtcataaacattttaaatataacttcccatattatagccacataatccacaaatatatactatgtaataaaaatgggaaataagtagtcaatgttctggataataaattgcaaactctttatcaatggtgtttctgacataaaatttctagatttattcaaatgaaaatgaggccaggcgttacagagatcaagcctgtaatcccagcactttgggaggccaaagtgggtggatcacctgaggtcaggggttccagaccagcctgggcaacatggtggaaccctgtttctaccaaaaatacaaaaattagccaggcatgggggtgcatgcctgtaatcccagctacttgggaggctgaagcaggagtatcgcttgaacccgggaggcagaagttgcagtgagctgagaccacactactgcactccagcctggatgaccaagtgagactccatcttggaaaaaaaaaaaagagttatgctatttctctattagtatcttagtatctctctaccaccctaataatcccacatcttggattgcttgtataaaacagtaaaatgtaacaaaattctaagagctttaaaaaaagcttttaagttgttcataaaacaagataagtgtataaattgtacgttttaaaacaaagtgaattaatatttaattttaaaactgacacaactttttaaagtatgggctgaagttcacgaacccatgggtttcaattatgtgctataatttcccacttcatgctaaatcaggcatcatattgtgatatttaatatttcacaaactgaaatgcacattacaaatctggaaagttattgaaaaggagaatacaaatagcatatatcatgaaatctctctactcaaaggaatctacaacagaaattttatgataacctgaagaacaagtaaacatctctccatattatttgaactcattatattctatacactttatactagagatgacttataaacataatgccaaataaaattacttttataaaaactatatgaattcaatatttctatgcaattttaaagagaattcattagtaccatatatcatacactttttagaaattgcacaaactctgtgtacacatacagaagcatgcatacaattcaacacttaattatctaaatgctacaatatgaagcatttcacagtaaaaatgaaaagtatcatatttgtatatgacacaggaaacttaaatagcatgactgctacataagatacatgtcaccgaaactgttctaaaggaaaatccacgttttcaaaataagaaccactttattcagttgtggaagattagtttttccaaagttctacgaattaatgaagtaataggtaacactcagagttatatttttatatttttaaccatatttcagtatattttatccttagagcagacaatacagctttctagaaattaattatttagtaattatacaatgtgtactttaattggcaacatcgagttttcaatgaagttttattaagtttgtaccatttatttgtattttctatttacaagtaggcaaagataaattgtataactgataaaatggtttctgacgaatatgcaaaatagttacaagctgttcaatattcatataaaatattttgttaccctaataatatgtataaaataaataatcttttatttctaagataatggaataattttatgcttagctatgtgaatattttttctgtaattataagcatcttataaaaataaaaacactaaaacaacaagaatagctagctaacttttacatgtcaattactcatgaataaataacatcaaattaggaaaaataaacatagcaataggacattaaaactgcatttctaagccccccaaaataggcttcctgattttatgctgctataaactccctaaatacgcttatttctaattgctgtaatagattgttagcagaataaatgggactggcattttatttttcttgtgtttccataaacctggattctcagggattgaaaaactctgagcaacttctgtttataaaggctttgagtgtattagaaaatgaagaatttaaaaaaacagacaacaccaaagttaggttattgtagatgtctctttgtatagcaaataaacatttttaacacaaaaatacactacagcatacatagttaatctagctatgattttagaatgtataaaattatgaatttgtggagcacagaggcagagtaatcatttaggattccagtgtgcagtcgcatgatgaaaggcttctttcaattctgtttacgtctgtgagtggatatacagcatatgggaggggcttgatcacaagtctgaactctaagtcccttataaatgtttctttttgcttctctgtgatggacactgattctatccgtttgtgttttttatcttctatctagacatgaaacgggcatttattggatgactttgcatggtttcttcaagcacaatgttagagggatgttttcagggccatccaacccattttagtaagggaagtcattagacgagcaaaatcaaaccttcaagaaatttcaacaggaagttaagaatagcagtcaataataataattgatggcaaggaagaataattctatcttgacttgcctggggaactgaagatcatttcctctagttgttgactgaaagtgcctaaaataaataaataaataaataaactggccctctaaaattttgaagtgaggaaatgtttttgttagggggtctgttttctaagtgacctgttcaggcatcatctatctccaagttttcacagagctccaggctaggaatggcatctaaggtaaaattgctccaaagaagaaaaagacattttagcttcagaattttgaaactacagtagttatgtatttctgcctaggttgcaatgtttagccgtaaacattgttgttaattatggattaaaaatcactggattgaaaaaaatatattttcataaatatcttagacatagatactgctaaggctagcagacagtagatatatcttttaaaactataactaaaaaattcggtcctgtagtttcctcactataaaggattataaagatagtctcttaggacccagcattatattctcagtatgatgaagaagttgccatcatacatctgatgtgttcttttttaccgcatgaggtacaagtgaggttattagtttaggatttgaatagaggaaagtgaatgggaaaaatgaagacatcaaatgatacagcaaattttagctgatagagtggggaagtaaacttaatagtaaaacattgttggatttggggcattactgaggtacagttataatcttgaaacaattcagtaaaattggtaaactaaatattgaagttttctcccaatatgctcgagttccttaaatggcttctgttttttcctaaaataagagcacagtttttaatgcagccccagaggtcctttatggcctgtctctcaccaactacttctatattagtttaaccatactgatgcttgtaagtagaaatagctcactccactcacaacacaaataatcttgcacatgttcttcaacaaaagcattgtactttcaatagagtcactttacgagtagttccagtttgtcgcacagaataacaaaagatgacactgaagcatcgttacgcaacaaaatttttaaattttacttttttactaaggactttatttttaattaattaattaatttagagatggagtcttgttctgttgccaggctggagtgcagtggcataatctcggctcactgtaacctccgcttccccggttcaagcgattctcctgcctcagcctcccaagtagctgggactacaggcgcccgccaccacgcctgactaatttttacatttttaatagagacgagatttcaccatgttggccaggatggtctcgatcacctgaccccgtgatccacccgcctcggcctcccaaaatgctgggattacaggggtgagccaccgcgcccggccagatgccctgttttaacatgttctagggttccagcagtgtttctcaccattgccttcgtattatcatttcaaatctcaagacagtgaaatgccataattttgacctctcaaataccgtgaacaaaatctcagagacctttaacaggtccacagatcactgtctcagaatctctgcctaagaataatttttacatgtttactgtttctattgcactacaatctcccagcctgtccaagaaatctcaaacacattttcagatataaacttatattcatgctaatagaaatcttctctgacacatctggtctcatcttcatagcaccaatggcttttcctttgagatgctcataatggttggaatttcccattaatttattatttgtttgaatttctcatcttctaagagacaacagatcataaaatcaaataattacagccccaggaagttcatgcataaaatcatggaattggacagtttgtggaataaaagtaagcagacacaaaatatctaagggaggggtgcatgatgctctttcaaaaaacatgcaaatccttccccttagtggaatacagacatgttgaaaattaaattggatatatcctaggactccagtttgtcacctgtgcctcagtttggaatattcataaggacatagtcactgactttgtatagattttgttttgttttgcctttcaaaaaatgttatagcagcacctagcactgtcagaaatacgttgaatcctcgtataagttcaatgaatgaaagaacacagtttttgctacctaaaatgttattaggatatgaatacataaagaatttggtgtttgagagggtaaaatagtgattctaggctcttcagtggactactgattgtaaattataagtgatttttgggctatgtgagacataaattacaatcaggtacagaaagttatactatgatgttgacaaaactatgtgcctgcaggactatagtggaatcaaattgatggctcataagttatcagaatgacaagtgatagctgtgtattttcccctccttctatagtaaatacacttgattccaagtgctacaaatggatgtttttgttgaacttgttaaagtgattgtggtttttcttacgtagtttattactatagtaaacaacactgatttaattttcaaatattgaaccatcgttgaatatccaggatgaaacccaatcgttcaatatgtactgtctttataatatttttaaatatgtttttaattgacaacataaaattgtttttatagttatgatgtacaacaagatgttttaaaatatgtataggatgtgaaattaataaattgttaacataattaacatatgttatctcacatacttctttataacacttcaaatctactcttttagcaatttccaagtatacaacatattgttattaattatgttaataacaccatgttctacaatagatctcttaaaattgttgctcctatctaactgaaattttgtatcctcctaccaaaatctgcccaaactcccctgaccccagaccctggtaaccaccattctattttttgcttctgagttccactctttaaattctgtacataagtacataagtaaaatcatgctatatttgtctttcggttcctggcttatttcacttaacataatgtcatctgtgttcatctattatgccagcaatgacaaaatttccctctttatgaagttaaataatattccatgtgtttatataccacattgtatttatccataattagattcttagattcaatcctccattaatagacacttaggttaattccatatcttggccattttaaataatgctgcaatgaacaaaggagtgcaggtatttctttgacatactgatttcatttcctttgactatatttgcagatgtagaattgctgattcataatggtagttctatttttatttttattttatttttcaacagtcctccatgctgttttatgaaatagctgtactaatttacattttcaccaacaacttgcaagggtttccttttctccaggtaattgccaacacttaatatctttagtccttttattttattcagaaaaccatgtttgccactaaacaatttgccagtaactccagctatttggagaaatttaattatttgactttcagtcttctttttgttattttgttttgttttgttttgttttgttttgttttgagacggagtcttgctctgtcgccaggctgaagtgcagtggggcgatctcagctcactgcaacctctgcctccctggttcaagcaatttcccctgcctcagcctcccaagtagctgagattacaggcacgtgccaccacgcccagctaattttttttgtattttagtagagagagggtttcaccatgttggccaagaaggtctcgatctcctgaccttgtgatccgcccgcctcagcttcccaaagtgctgggattacaggcgtgagccaccgcgcctggcccagtcttttttataatagctatattaacaggtgtgagatcataatttattgtggctataatttgcatttccccagtgatcagtgatgttgagcattttttccaatatctcttggccatttacgtgtcttcttttgatagttgtgcctattctgatcctttgcccatttttaatcaggttattttttttctcgctattgagttgtttgagttccttacatattttgaatattaaccccttatcagatgaatggtttgccaatattttcccttatcctataggttgtttattaattacattggttgttttttatgctgtgcgggagacttctattttgctatcatctcatttgtgtattttgtttttgttgcttgtgcttttgcagtaatgtccaaaaatttattgcccaaaccagttttataaaatttttcctttttattttctcctaggagctttacagtgtaggttatatttgtagtatttaatcaatgttgagttaaattttatatatgatgtgagatggggtatatttctattcttctgtatgtagacatgcagttttcccaacaccgtttgtgcaagagattgttctttcccacttgtatattcttggcatctttgtcaaaaaaaataaatggacagtaaatgcataaacttacttctgggacctctattctgttccactggtctgtgtgtctctttttatgctagtaccaggctgtcttgcttatcatagatttatggtaccttttgaagtcaggtattgcgatgtttccagctttgttctttttgctcaagattgctttggctatttgaggtcctttttagttcaataaaaaatttttcatttctatgaaaatatgtcattgtagctttaagagtaattacacttgatatgttgattcctttgatagtatggacactttaacaatattaactcttccaatgcatgaataggggccacttttctattcacttgtgtcttcttcaatttcttgtgtcagtatttcataatattcagtgtacatgtctttcaccaccttggttaaatttatttctctgtggtctttcttcttataactattgtaaatggatttttttaattttttttaagatagttcactgttagtgtatagaaatgctactgatgtttgtatgttgactttttattctgcaactttaataaaacagttttctgttgaaatctttagagttgactatttataagatcatgtcacctgcaaacaaggtcaatttagccttttcctttcctatttggatgccttttatatctttctctggcctaattactttgtctaggactccagcactatgttaaatagcagtggtgagagcagacatcctgttcttattcacaatcttagagaaaaggtttttgacttttcaccattaagtgtgatgttatctgtgggcttctcatatatggttgtttttgtgataagatacactccttctatacctaagttattgagagttcttaccatgaaagaatgttgaattgtgtcaaatgttttttccatatctattgagatgatggatataatttttatctttcaatctgctgtggtttatcacttttgttaatttgcatctgttgaattattctcgcatcccaagaataaatgccacttaatcatggtgagtgatccttttaatgtgctgcttaatttgatttagtagtattttgttgagaattgttgcatctatttttattagagatattggcctgtaatttccttttttctagtatctttgtctagttttgatattaggataatgatagactaagaataaaagagagaaggcacaaacaaataaaattacaaatgaaagcaaagatattacaactgaaattacagaagtacaaaagattacaagagtctaatatgaacaattatacactaaagtttggataacttggaagaaaaagataaattcctgggaacatacaaactaccaagactgaatcatgaagacatagaagatctgaagagatcagtaatgagtaaggaaatagaatcagtaataaaaagcctctcataaaacaaaagcccaaaatcttcatactgaattctaccaaacatttagataagaactaatactattccttctcaaagtcttccgaaaaattgtagaggagagagtaataaaaactcattttatctttattttttttgtaatcagcttgcttatataatattaggaattttgtgttcaattttataaagtatgctgacatgcattttacttatcatttatttgtctggtatttctatcaatgtaatgttgacttcatacaagacttgcaaagtcctctcccatttatggaagagattatatgtaatggttattttttcttcctcaaatttatcttaagtactttcctataaaattatctgggcctgaaactctatattttgtaaattttatatttggtaaatttctactttggtaatgcttttaactttaaattcaagactatttatgttatctagatcttatgtgagtttcagcagtctcttttcttctaagaatggttacatttcatctaagttttcaaatgtggcatagggttgtttatggcatcccacttttactcttttaatgattttgaaatcagtagtaatattccttgtttaatttctgatattggtcatttctctctgtctttattctggtttctagatcttttctttattgtctttttaatctaaaaagcaaacaaaaaagtggttctgtattacttgagtgtatattttatgtttcatttttttaaaagctccccagaagaatgatctgggaaaaactttcagaaatatataattatgtaatgtacaataataaatgataatatagcaaaagttgtgtagcttttttgagtagcttttaaaatgctttctgagtgtatgttttcattttctgcaaagtgctttatagttatttacacaatgaaacaccaacagctcagtaataccaataagaaaagaaaattacaaactttaaggtgtgagctcaaagaagtattgccagaatctgaaactccatgaatttataataaaaacttttgattcaatttgtctttttctgaaacaccaaagttatacaataagcagaaataggcttaggacaaactatacatggggttgcattctaattaactacttagaaaattagtcattacaagaaatacatctattttgttaaaattgagtatataattaattgtgagccaaaataagtgaatatagaaatacaaaaaggaatcacttcataattagttgcaatggtagcagtggagactacacttcatgtggtttccctccagaaacctcaccaggttctcttggtaaggatctgagaaagatctcctagtagtgctgacaaggaatggggaaaaatagtcattatgaagcccctaagatatttctttaacacatgcctactgtccaggaggcaagacatcaccaaagaacaacactaaaaatttatccccggtgggaagacatatgcttctcacttcaacaccttcagcctttctgcctcacctaaggaagaaaaaaaagtcaaaacaaaagaacaaaacatagtcaacaggggagagagagctaaagaaactgacagggaatatttggccagagaatggagtagagatagcaacaatagttaatgaattaacattaaaaaaaaaaaaaaaaaactatacccaaacagaggacaagaaacacttgtaaaggccacattcccaaaacacagctccagttagagactgagatttaattagaggattacagaacatgtccctttctaagctccaccaacactctaacaaaagccagtttaattacactggattacagaagaagtagctgtaagacaaagactccatctaaggagcagtacaaaaggaaacctcaaaggcaagactggagagaaaaacaggcaccctagcaaaatttaagttctctcctaactacagctacagtaaacataaaatacagtccacacttagccagattaacatatcagtccttacactagggacctatttaccacaattcgtattacctgatacaacatgtccagctgacaacagaaaattacaaggcataccaaaggcaaacagaaaaaaaaatagaaaaggaaagcattctgaatagacaagcaatcatcaagatcagaatagaaaaacacagatcttgtatttatcagaaaagatatttaaaatgattgtgctcaatgtattaagagatctaatggaaaacttgttttttcttattaagatatctaatggaatatttatttttcttacattaatgtcagcagagagagaagacctataaggaaaaaaaatcaaaagaaaatcctgaaatcaaaactactgaaatggaaattaagaatgctcttaataggcttgctatggtttgaatatgtgctccctttaaaatcagctttgaaatttaagtaccagtgcaacagtatttaagaggtgggccattagtgggtgatgactccatgagggccccatgctcatgaatgagattagtaaccaggaagggctgaagagatgttgctgggtcctttctgccctttcacccttaaggccatgtgaagaaacagcgttcatcttccctggaggatgcagcaacaaggtgtcatctttgaagtgaagacttggcccttactagacgtcgaacctgctactgccttgctcttgaaattccagcctccagatttgtgtgagaaacaaatttctattcttcatacattacccagtctcaagtattttgttataacagcagcaaaggactaagacaaagctcatgaagactttcaagaaaactgagggaaggattaatgagcttgaagataggttaatataacctgtaactcaaagggaaccaaagaacgaagacacagatcaggacatccaagaactgcggaacaatatcaaaagttatatccatatcaaatgccaggaaaagaaaagattaagaataaggcaaaataaatatttgaaacagtaatgactgagaactttccaaaattaatatgataaatcaaatcacacatccaggatgctcagagaatgccaggcaagatgaatatgaaatacacacatacacacacacacacacacacacacacacatacatgtatctaagcataacatcatcaagctgcaaaaaaaaaaaaaaaaaaacggggaaaatcttatagaaagttgggtacatcttaactatagagaagcaaagataagaatgacaatgcacctctcatcagaaatcatgcaaccaaatagcctggagtaacgtttttaagtgttgaaagaaaaaaaacctgccaacttagaataacatacgtagcaaaattatccttcaaaagtgaagaagaaataaaggctttttcagaagaacaactgaaggaattcattactggaagatctacactgcaaaaatattaaaagaaattctttaggttaaataaagtaatatacatgagaaacttggattgatgtgtaatttttaaaaagtttttcttatcttaatagatcgacaagataattatggacagcaataatagcaacaataattaattcatcattgctcagggatgttagataaatggcagtcaaatcctcacgcctataatcccagcactttgggaggccgagacgagtggatcacctgaggtcaggagttcacaaccagcatggccaacaaggcaaaaccccatctctactaaaaatgcaaaaattagccaggcatggtggtgggcgcctataatcccagctactcgggaggctgaggcaggagaaatgtttgaacctgggaggcagaggttgcagtgagctgagatcaggccactgcactccagcctgagtgacagaactagactttgtctcaaaataaataaataaatggcagtaaaatcacaagaaataagacagacgtactggtaatactatgttatgaggtatccccactacgctcacagtaattttttttttttttggaaacggagtctcactctgttgcccaggctggagtgcagtggcacaatctcggctcactgcagcctctgcatcccagattcaagcgattttcctgcctcagtctcctgagtagctaggactacaggcgtgtgccaccacgcccggctatttttttgtatttttagtagatactgggtttcaccgtgttagccaggagggtcttgatctcctgacctcatgatctgcccgcctcagcctcccaaagtgcttggattacaggcgtgagccacctctcctggctcataagtttttatttgacattgtacttggattatttaaacatatatgttggaaaccctagggcaaccatttaaaatgtttgtgttaagtataaattaaatgctgacagaaaataaaattaaaaagtataacatactaaattaaaaccagagaaaatagaaaaagaggagggaaaataaagaacaaatgtaatgatgattgaaattaatgaatagctttcatatatcctggaaatattttgaattaatataaatttatatatcagaaaaatgtttatcctcaatagattggttaaataataattaaataattttagcgttaaattgaagttgtttaaataaaaatgttttatactgtttaaaaataatgttttgtaaaataatgattatccctaaggatgtttataaaattaacaaccaaatttaacaaatttatttaaacatgatttaagaaaaacatgctaaataaccaacaggcatgagtgagtcagatctagatgtagatggatcaagaaattatagtttaatcagtcttgtatgtaaacactgttgggatttccaagccattgtcatatttagagacacacatcaattaaaggttagcacataacagaatgcaacttgctggaatagatcatgacattgatagagtcatttttttttggtaacacttaacattgcttacttctgctttgttttttttttagacagtgtctccctctgtcacccaggctggagtgcagtggtataaacatggctcactgcagcctctacctactgggctcaaaggatcctcctgcctcagcccatgtagctgggactacaggcatgcaccaccatatctggctaattttttgattttttaataaagatggggtatcactgtattacacaggctggtctcaaactcttgggctcaaacagtcctctcacttccgcctcccagagtgctgggacacaaatgagccacagtgcctggcttattgtttatttttaactttttttttccttaaaatgatttgttgaaagctactcagtggaactctctgagaattatacaacctgtaagcctgagggaggtggtaaattcttcctcatccaactttgtcaagcagaacctctaaggaagttgataaagaaaatattgagcctttgccttcatgcttcagaaataagtaaaggagaaatcatgctcacctagcatttagttggagagaaaaatacagtagtaatgttcaactttttctcagaacagagatggatgcttttcttcaaggcaagaggcagcaatgttaacttaaagggaactaggaagcattagaaggaagaaatatatgatatccacacaaataatgaagaacatgtggttctacccttctacatttcagcaggtctgaatcatttcttacagctattcctgccataggagccattagattcagaaagcagtaagaaaataacggaaagtagcaaactactgattcataagccacttttctcaaacctcaagagttttttttttttttttaacattcacttggtaacctgtttaaatccttgtctgtcttcaaaatgtgtgacaacagaaagcaaaggtggtctacaagtcaaccttatttaacattctgtggggtcaaatacaaaagtgttgatatgattattatcaatatattggtatagtatttctgtattgatatactgatgtagtatctctgtattgatatattgatatcacatctctttaaagatggtagagtgaagccctggtgataaggatatgcagtttgatcccaattctgaaaaagttcattctatcatctgtcttatcattcattgacccactttataataatggagcaaaagatcaactcttaaaattctcttgctttaatataaacattagaaaataagtgacaacctgcaaataaaatattttttaaaaaaagtaacagagatcagtttattactgattaaattattctttattaaaatgtgactataattttaagtctaaatcaaattagtttattaaacttatatatgttaatatctacataaccataacagacataataatttaaaaatataagctactaaccacaatgcctaagagccctgtagctttgtaaggaagattaaaaacaaggacacaactacaaaacaatcactaggtcacatatcttggcctggattttctcatttagctatcaggatagcgtgacgactatatagtcactcttctagctctataagcaactttagaaattaaggagacaaaactctgtataaagtgtacagtagtcctctctaatccacagtttcactttctgggttttcagtttcctgaggtcaaccacagttcaaaactattaaatggaaagttccaaaaataaacaattcataaactttaaattgagccatgttccgagtagtatgaggaaatctcactcagtcccgctcaagacatgaattctccctttgtccagcatctccactctacctgctcagtagccactcagtagccctcttggttatcagatccactgtcccagaatcacaacacttgtattaaaggaacccatattttactaaataacgtccccaaagcacaagagtagtgatactggcaattgagatatgacaaagagaaactataaagtgcttcatttcagtgaaaaggtaaaaattctcaacttaataagccaaaaaggaaaaatgtatactgagcttgctaaaatttaccctaagaacaaatctatccatgaaattgtgaagaagaaaaaaattgtgctagatctcctgttgcacctcaaactgcaaaagttatggccacagagcatgttacatgctcagttaaaaagacttcaaatttgtgggtgaaagacatgaacagaaatgtattctgatataaggcaggcaggttcattctaccatcccaagtagtgtcactcactagggatttgggaacatatttcaagtagagaaagacagactattctaccattttttatttctgttgcccattttcccgatcagatgctttaccatttttatttattttatcaatgagataatttttaatatacttattagagacaaggtctacctattgtccaggctagagtgcagtggcgcaatcatagctcaccttaaactcgaactcctgggtttaagcagagataatattttaagactaatttatgtaacacaaattaatttggcataaagtatgcccatttcagattttttataaatacagacatgcatcatataatggtgtctctgtcaaatatgcactgtatatacatctattttgccataataggagctaccctatataggtgtgccatattttagtcttttatgctgtatttttactgtactttttctgtgttaggtctgtttagatactgaatctgaatgctctcaattaaaccatgatgccttccactcacaaatttaatgccttttccatcttaactaagcacttatcacgcatgtggctgtaacttttgaagtttgttgtgctacagcagaactagcaccaatttttttcttttttcttcacatcattatggatagatttgttcttaaggtaggttttagcaaccccagtatacaaatatttttcttttcttgttaagtaaagaaatttcagcttgacacgacagcacatgcttgtaattctagcacttttgggaggctgatgtgggtgtgttgcttgagtccaggagttggagaccagcctgggcaacatggcaaaaccccatctctacaaaaaattagctgggccatatggtgcactactgtcgtcccagataaccagaggcggagtcaggaggattgcttgagcctgggagatcgaggctgcagtgggctgtgattgacccactacacttcagcctgggtggcaaaaaaagaccctgtctcaaaaaaataaaaaataaaaaataaaacaattttctcctttttacttagggaaaacactttataacttctctttgttatatcttttttgccagcatcgctactcttgtgtttgggcttctaagtggctaatcagaaaggagcttctgcagcctggaacctctggaggaaggtatgattcatcttccaggacagagctggacaacatgcgatttcatcactctaccgagcatggtacacaatttattaattatgaattctttacttatggaattttttatttaatatcttcagaccatagttaaccacaggcaactgaaacagtaagaagtgaaatcatggttaggagaaacaactgtagagcaaaagattgctaattccccataactataaaaggacaatctcacaattaaattgcagcaacagagagcttattattgcacacttgttgcagcagtaaacatttggaagcaaatatagtctccacaatagagagattgattatattttgctatgcagttattggcaaggtataaagaaaattttttaaagctgtaaaatattttctataggtatctattgtttaaatgacaatgtgtagtgtgtgtacattgtttttgtctggacatagtctggggaacagttattatgtggaggaaagacctggatggagaagagctttttatgtaaatacccttttaaattttctaagttttgacatgaaaaggagcacctggacataatttgtattatttttctatttctgcgttaaaaattaccacagatttaattatgtctttaacagcttttccacaacatagaacaaccgaattactgtttgacagaagaactgtatacactaggcagcaagaatcttggtgccaccttggatttttgcctagcacaaaattttgatctctttatttctctctctccctgtctctctttgactgatacaattaaaaatcaggcaaatatgactctctatgtcatatttactaaaaatattgtttactaaaattattgtttgtatatatgcatgcacatatataaacacattgaaggtctatgtggataaacaaaaaggtttaggccaggggcggtggctcatggctgtaatcccagcactttgggaggccaaggtgggcagattacctgaggtcgggagttcaagaccagcctgaccaacacggagaaaccccgtctctactaaaaatacaaaattatttgtatttttacaaatacaaataattggtggcaggtgcctgtaatcccagctacttgggagactgaggtaggagaatagcttgaacccgggaggcagaggttgcggtgagctgaaatagtgccaatgcactctagcctgacaacggagcaagactccatctcaaaaaaaaaaaaaaaaaaaaaaaagaaaaagaaaatgtttaatgggatgatccagagtgggaacaggacatgctgactaggaatagtatttgaattctttttgatgttaaaaaggtgatgataaaggtagtcagtactaattgtgtattaaaattaaaaagaaaaaccaaggtaaagaaggacatgattctaaatatctcaaccgctcgatggtttattttaaagaactgggtaaagtatttcagtttgttttactttggaaaatcattatgaaattttaaaagaagaaaagtacttcagttattaataacacacatttcatttttatgtctatataaaaagcgagataaaatgaagctatgaagtaagtttgtgctgaagtaccagttaatggaatagaccacttaagttttacataaagctattgatggggtttatccttgccctaatgctgctactcatatttgacagactgccctgaataggaacatgctttcattttgatttttttgtcaattagttcccctaagaaaaaatgtggtaacactgctattcccattccagagaagaaaattttaacaacaaaaaattaggttgctcaggagcacatagacggtaaggggcagagcaaacacagcctgcagagcctgtgctcttcacagctatgctagccttcctctcctgcccatgaaaaaacagggatgagtttgtgcttcagaaagagccacatgctctgtggaatactatacagcaatgaaaacaaagtcaatggaactacatgcctggacatggactcatcttacaaacacgatactgaatgaaaggagctaggtacggggtgtacatgacataaaagcgagagcatttgctctgagtatgtaacaggaaggggacacgatggggactcttgagggcttgatttgagctagttacacatgtgtgtacatttgattaacagtcaaacaacatttgtgaatttttctgtgtttatggtatacatgaattaaaaatatatttaacaaaaagggaagagtatcttttcctccagctgatcatgaaaagcatgttttttcttttgttttgtttttctttactggcttttagaaaattgaagctaccattaatagtctctcataataaatacaggtatcatcatcttttgtatatctatttcttattcagttccactccatttaattctatttattgtcttccttttgtctgtttatatgaatggaaattgaaaaaccaaaatgtactgaaaggatcagtagtcagataccatatataaatattgcctattaataagtacttagacaaccttgatgaataatgtttttcttctttttcagttttctttgacagagatccatgtattctggaataagtagacaatctgaaaaaaacataattagatttcatattttctttatttgacatctcacgaatcaatcttcacattgaatactgagagacatgacataattggaccttgcttctatgaatagaactttggataaaggatccctgttctaggcatttcttttatatcttatccttgaaattctcaaaacactttatctgatctcttatagtattgttgacatttttttaaatctgtttgccaccaggcaatgagttaaaagactgggttatgtctgaaagattatagtgtctgccaattacttgattttcaatatatgcctgttgtctacactgatattcctgctctcaaatgtaaagcatctttgcattactgagaccactctgcaaaactctgggatctttaagaattctgttatggcatcctgtcatagtaatattttatagtggcatcaggcactttacaaatgagtgagtggatggatggatgacttttctggtaagaccatgttatttacagttatatgactttaaaccaccttttttttccttctatttctttgaatatcatggtctattatcagtagtgtttgtaataacactaagtgtctcctggaaatatttcaaaacactcactgtaacttaatagtatatttcaaaataatgaaagataacactaaataatgattcaagtctcaaaatttatcatttttcccaacaagaaagaggagttaaatgacctgctacatagtttattccattctcccattagctaagtagccagaaaatcgtatgcaatctagtgctcagtctgacaagaaaatgtagattatcaattgcttctaaaacagagcatttgggcttcaactagattaagaaatgttactatttgtcaaaaattacagagaaaccattattttatattacaaacctcaatgttttgaaaaccaatagtggacattatcttttgacatttatagaagatatgtaactctttataaatctttttaaacactctagtgcagatagaagctacagcacagaatgcttggctatacttgaagtaaatactctaggttatttatgccatccttactgtttgaaaaaaaagtttctgttgtggcagggggagtgtggacagaattgaatactccaggaaatggaagatttaaaaatttaattctgatttttgttcattccatttacagggatgggggtaaggggacaaaaattggtatgtattctcacattgaatactgagaaacatgaaataattggaccctgcttctatgaacagaaccttggataaagaatccctgttctaggcatttcttcttattttagagttttgtagggaaatttgaatttatatattattgaacagtttctgtcactgcagatagacacttctctaaattattatttcacagtagataaatacacaaacaacttaacattagcttttgatcacttgctaaaattagcattagtcaataatctttgtaaaacatgtaactattaactctttgttttttcttgtctgaaactgtcataaaaattgtacctatctgatgtcgttattatgatgttcggtgagttaatacaatgtttgtaaaaatgccaaacatgctgctcataaatattaaaacctcatgaataatacctattattatgactagctcaggaaccactgttctatttcagtaaaatatatttatagagcattcaaattacagatagggtaagtgaatggcgattggattagcaataatggctcacaatcagaaatcaaaaaccaaaagtcaaaaaggtgaatctggtttcatgttttgatagatctatttgattgaaaaaacaaacacttttcttcactctcagtccttagaacccacctggccctccactggcactgctctctgaggaaaaatggagcggagtgggggtcaagggttgacactttctccagcttggcctctgtcacagtgagtgacaaaagcctggcctgtccctttcatggtaggtgttttcttaataaaccaccccaactcctggcagctcagctctttcctgctcagctgaactcctgacaaatataatgctccagtaaatggtgttagatgactcaagaagtgacactatgataatggatgctgatattaaagtacatgtaaaaagcttggacaagatgtttcattaaagaaaattagagaaaagcaatatttttaaatatgtgggtttaactatgtatgtatttatataaatatgtttgtgtctctgaaaatttattcaaggtttttagatcttttcagttgtaaaaccaatggattatatatttgaagatgatttgatttacattgtaatttgctcttctgtgtacagaagttgttaagtaataaaagggtcacaaggaaaacaatgaagaaatattttttattttatcttaaaaaaaagataagcaaggacctcaattctcataatctctctgaacaataattgatcactttcattatgaaaggtatcaccgggcaggaaggtgataaagagaacatgggttccaaattttctttctttcttttttttttttttaattattatactttaagttttagggtacatgtgcacaatgtgcaggttagttacatatgtatacatgtgacatgctggtgcgctgcacccactaactcgtcatctagcattaggtatatctcccagtgctatcccttccccctccccccaccccaaaacagtccccagaatgtgatgttccccttcctgtgtccatgtgttctcactgttcaatccaacctatgagtgagaatatgcggtgtttggttttttgtccttgcgatagtttactgagaatgatgatttccaatttcattcatgtccctacaaaggacatgaactcatcattttttatggctgcataatattccatggtgtatatgtgcacattttcttaatccagtctatcattgttggacatttgggttggttccaagtctttgttattgtgaataatgccgcaataaacatacgtgtgcatgtgtctttatagcaaaagcccactttctagaggggaaggaactaaaactcagacgtctatgtaaaacaatgcaacataaaaataaataagtgttgtggcaaaacagatacaaggaaatttagactgtgactattcatgttagaaattgcttttcaaaggaactagcattagattggggtcatgaaaggtgcgtggaaattagccagtagtcaagtaggaaaatatgcaaagaaacttctggtcaaaggcagaatacaagtttttagaaattcagtgaacacacacacacatatataaatattatctttctttctgtcgactttcttttctttacttttttaaaatttctatcacccattcctttatgaaatgtctaaactttaccaattcgctgggctgggttttagaaacacgacattagataatacaaattaaatatcttttaagagttatacattgtaatataaatatagttatatatgtttatgcatatatgtgctcacacacacctatatatgtgtgcacatacacctatatatgtgtgaatatatatgtgttttatacacacatataaacatacaaagaaaccacatatatatataaatggcctttaagaaggtaacaattaagcagaaacttaagagaaaaaatgaacctatatctgagagatgattgttccagatataggaacacaagggcaatggttttgacgcagaaacatctttgctgtatttaactgataaaagttagtattgttggagtaccatggaatagaggaagtgatatcagagaagacaacacagcaaggcaaaacaaggccttggatgtaagaccaagcacattggaaaggcatcgaattttgtgttgggcaaggatgacttggactctgtggaaaatgtattctgaatgagaaagagtggaagtatggataccacctaggaggttatcatagtagtttacatgacaggtcagaatgatgaggttttggaataaaatggtggcaatggaggtggcaaagtgtttcaatttagaatatttattgaaatcaagcccacagtgcattaagaaagactgatttttcaggtgtgaaggaaagagaggaattgaacttgatcccacctttctgatgtgaacaactggaatatacatatttcatttctctaatagagaatgcctggggaggagcagaatctaagacattctgagagaatggaagtctgaattacagagagagagtaacaagaaaagaatttataattaggactattgtataagtaatctatcacaacatcctgagaagatttggtgacatgaaggatttttaattactgaactgctataatcagaataatgttttagaatgctatctaaaatattgtcataaatattaggttgacagaaagaaataagatgggaagaaagagaataagaagcaaaataatgttatgatttgtcctatggtagaggcaggcaatggtgtggagaacagatatttgtttatttaattttacttagaaattgctatgtgcaatccctgtgctgtgcagtacaaggatgaatgagttgactacaatatgattcttccactcaaaaaaaaaaccccaggattttagaatgtatttggaatcttaaataaatgattattatgtttatggtttcttagtctagtgttttaataacagatatggtggttttcatacattgaaattccctttcaaagcaaaatttacctattattctgcacaacggacaagtaatagttaataataatatatatgcttgcatatatgtgcacatataacgatacttcagtaggaaaaatccctcattcaaaattaatacactggaaatgtattccactggatgtatccactggaaatgaattccaggcatctcaaatcactaaagtatatctaaatgaagaattgaaataggccaggcatggtggtgcacactttggtcccagctacttgggaggctgagatgggaggattgctttagcacaggaggtcaaggctgaggtgagccataatttggccactgttctctagcttggacaacagagcaaggcccactctcaggaataaaataaaagaagaattgaaataaagacaatgatccagaaatcttgagtttcttttcaatgtccagaaatgtatagaaagtgagagttaaatatatgagcagacaacaccgtctgacagcttggatgagaaggtaacacaaaaggttgtgtgagaatctttgactgataaaaaaacagtatctaatattcactctggttttcttaacacactaatcttatttttttcatagcaggtgcctaatgaatattaggtaaataaatatggtagatcaaaactaatttcctttttaaaatgagttttctacaatttatacaagtttttatagatgatagctcaaaaatatttgatttacctttaatgcacacaatagcttaaaatgagatttagctgatttcttataaacaaagttacatgaatttcaaggtgggatggcatcaaatgtagaaaaattgtgaacttggacaacagtataaataaatagttgattcattaggcttctttgccaatcattatgccaactattttacatagattcctttagttaacctcatatctactgtaggaaataaacacaatttttattcccattttgcagaaaaagatgatggaagtctgagtaactatgagataggatagaaatgtttaacaaagcctttagttctgccactcactctccagataaaggcacaatagggttttcaataattctaaggagagattttctcctgaggcatctgtgaatctgggccatagaatgtgcagaatccctggcacaaataagtaagaaatcaattatttcacattatactttaaagaataaaactcccacaaaagtgctagaaaaggagggagaaaaaaaaaaaaaaaaatcttgtcatttcctatgttctcaactttcttaagttcattgccctttagaaataccatgctatttcattcattgaaagtacaatatgcgtttgataaagtatttagataaggactttttctcaacattcaacctcctatcttccattggattaaaattaaaactgtgcttgttttctttaagctaaggtaactagagagtcaaaatttgaatggaaaatgtgtgtaaacgattacaagttgtaattaaagtctcagaaatgccaatattggctgattgtttctttaaaaaaaatttatataactctctttcttttaaaggatttatttttgttaagaatttctttcttttttttttgagacagagtctctctgtcacccagactggagcacaaccttcagctcatagcaacctttgcctcctgggttcaagcaactctcgtgcctcagcctcccaagtagctgagattacaggtgtacaccaccaaggctggctaattttggtatttttaatagagatagggtttcaccatgttggccaggttggtcttgaactcttggcctcaagtgatccacgtgcctcagcctcctaaagtgctgtgattacaggcatgagccaccatgctggcctttgttaataatttcaatatttttcgaaaagctacacattgtattattatggttttgttctatttagaggtttttggcatgagaatttcttgtcaacgtacaaattactcatttagtaaattgcattttggaaacacaaaaaccgtctcagtgtctcattatttataaataccaaagctgtaacaaatgtacaatagcttagtatattgtacagtatactccaggcttttagaaaagttattggtgccaacatgccctttaaatgcaagtagagcaaaggtgcatttcagaaaaataatatcatcttgtggcctttgcagcatggaatttactgataaagacaatagagtctgaaccaacttctcaacactgaacagtagcagaaatattaaatctaaacatttcaaaatatggaatgtcaatcattacatttgtagatatttttgcataacttttcattttgaggcagtaggtcaaggagtttgagacttcatttaattaaacagtattttgatatactcttgactacagtctcttagcaacagtgtaaaatgtaaattacattaagaaggaaaaatcagaatgtaagtatatttacagatgaatattgaaagagatagaaggtcattatagtaatcataattccaatattctagaaatcaaacacaaagaagtacacagtctgacgaagacatcatggatgagtccatcatcaggcaggaaggtgatattggatgatacgttgacatagtaattgtataaataaaaatatgtttgaaattaattaggtgagaatttgaacaatttttcaggttacttgagcttacgtatagtgtccattaaagcacgttcttttttatctaaacttattcccatatgctgagatcattccactctttttatagttaagactctattatgtactggcataaaatctgatatttctcctttatgtcattcgttacaactgcatttaattttatttggaaattgtttaattgttttttcacgctaggttgtgtgtccaatgtgaacagggtctgtgttgctacttcataactgtatccttgatgtctgacatataatagataatgtacaatttttatccagagttttctagggagagatatagagagttagaagtagccaaaaagaatacaaatcatactgtcaagtagatcacaacctgagttgtacaggaacacatgtaaaaatgttaaatattcatacatgcttccatttccagttatgatttaacataggtaagttggggttagagaagcatgtggtaatttttaataatctagagatgcagaaaatatttttgatcagatatccataaggatgttaattttcagctgctattctagcaaattgtaatgattgtcacgaggacgttctccatttatattcatgaatataaacatttcagagttatagttaccttcgagatttgattaaagctctagattccctccagcagaaaacaaaacaaacatttagaaaaagcacaagtgtttatttcttatatttcacttcatgaactttttgaacctttgtaatggatttcaacttaaaacctttattttagagtgcaaggaactatttttatactgtttacaattgttgtaactgtagtatacaaggcaaatagtttcatctatatttttcctgatgtgtaagcgtcttactgaattacagtgtttgattcttcacttgataattgtcttttggttatttaaccttctactgactgaatttcacatctctttgaactatttttagatatcagtaataatctgtgtagattggatcagaactatatcctacaaataatacattggcgatttgggtattctctagttaaattgctagtatgttcataactaaagtgagttttaaatgggctttgtagttgttgtttaaagacagatatttaaacaaaggctctgggtgtaataacaatgatgctaccttcagtgcacggcaggcctttcatccatggagcataaaatgcctcacttatgccatcagaggtgggaatgtggatgtgtaaacaactttccacttggtcgggatgtcatccagctatggaaggaccatcttttccgtaataaaatcttcagaggatgagacttaaagagatcagagggagaaaaattatttctttatgaggattttttctttattccctgttgtaatcttccaaataagaataatcaaatagatcactttttattagggagataatagctaattagctaaaaaatagatagatatacacatgaaactagagaagtccctgcaccaaatccatgtaaaggctctactctttcctatattttgacatgattgtatatctagaaaaccccatgtctcagcccaaaatctccttaagctgataagcaacttcagcaaagtctcaggatacaaaagcaatgtacaaaaatcacaagcattcttatacaccaatagcagacaaacagagagccaaatcatgagtgaactcccagtcacaattgcttcagggagaataaaatacctaggaatccaatttacaagggacgtgaaggacctcttcaaggagaactacaaaccactgctcaaggaaataaaaggggatacaaagaaatggaagaacattccatgctcatgggtaggaagaatcaatatcgtgaaaatggccatactgcccaaggtaatttatagattcaatgccatccccatcaagctaccaatgactttcttcacagaattggaaaaaactactttaaagttcatatggaaccaaaacagagcccgcatcgccaagtcaatcctaagccaaaagaacaaagctggaggcatcaagatacctgacttcaaactctactacaaggctacagtaaccaaaacagcatggtactggcaccaaaacagagatacagatcaatggaacagaacagagccctcagaaataatgccacatatctacaactatctgatctttgacaaacctgagaaaaacaagcaatggggaaaggattccctatttaataaatggtgctgggaaaactggctagccatatgtagaaagctgaaactggatcccttccttacaccttatacaaaaattaattcaagatggattaaagacttaaacgttagacctaaaaccataaaaaccctagaagaaaacctaggaattaccattcaggacataggcatcggcaaggacttcatgtcaaacaccaaaagcaatggcaacaaaagccaaaattgacaaatgggatctaattaaactaaagagcttctgcacagcaaaagaaactaccatcagagtgaacaggcaacccacaaaatgggagaaaattttcgcaacctactcatctgacaaagggctaatatctagaatctacaatgaactcaaacaaatttacaagaaaaaaacaaacaaccccatcaaaaagtgggtgaaggacatgaacagacacttctcaaaagaagacatttatgtagccaaaaaacacatgaaaaaatgctcaccatcactggccatcagagaaatgcaaatcaaaaccacaatgagataccatctcacaccagttagaatggcaatcattaaaaagtcaggaaacaacaagtgctagagaggatgtggagaaataggaacacttttacactgttagtgggactgtaaactagttcaaccattgtggaagtcagcgtggagattcctcagggatctagaactggaaataccatttgacccagccatcccattactgggtacatacccaaaggactataaatcatgctgctataaagacacatgcacacgtatgtttattgcagcactattcacaatagcaaagacttggaaccaacccaaatgtccaacaatgatagactggattaagaaaatgtgcacatatacaccatggaatattatgcagccataaaaaaatgatgagttcatgtcctttgtagggacatggatgaaattggaaatcatcattctcagtaaactattgcaaggacaaaaaaacaaacaccgcatattctcactcattggtgggaattgaataatgagaacacatggacacaggaaggggaacatcacactctggggactgttgtgggttggggggaggagggagggatagcattaggagatatacctaatgctaaatgacgagttaatgggtgcagcacaccagcatggcacatgtatacatatgtaactaacctgcacattgtgcacatgtaccctaaaacttaaagtataataataataaaaataaaaaaagaagggaaggattagagagttgtaggttttataacattatgtttgaagaactacatttactataaatttgaacaattttccatgtcttagttcctcatctgtaacactaaggtaagaaaagattcttattcacgttactgttttctttttatttttaatttttctgagataaggtcttgctttgtcaccgaggctggagtacagtggcacaatctcggctcactgcaacctctgtctcccaggtccaagcaattctcttgcctcagcctcccaagtagttgggactacaggcactcaccactaggaccggctattttttgtatttttggaagatagggtttcagcacattggccaggctggtcttgaactcctgacctcaagtcatctgtcgacctcagccttctgaagtactgggatgataggtgtgatctaccacacccagccaacattatttctatgaggagtaaatgagccataaccactattcctctactcctggcacatagtgatatctcagtattaaactcaacgaatttcaaagtaattttttttaaatgcaagtattgatgttacaatatgacacactgcatgtatttaagtagatgcgatggcagaaagtatttaaatggttttgataattacgtattttctttggaagtgagatggtaaattatttctaatttgtgccaattatttataacatgattttcttgaaaaggtctagtgtatttcatgtcaatttatatagctgattttcaaaaatactctaattttatacagtatctatttcaatatgagttgtcatttctacatatataaaaagtataggattttcaaattttgtattcgtactgaaatgatatcgatacaatctattttcttgaccactttgtgggattcatgagagggatgccccatggtcaacctatggtacttgacccctcgagggagggagcaagcaagggaatgagcacgggaaccagccagctgcttctgcgccagcaggagcaatctccattactaaggcctgctgcaccccacccttcatgggagggagtgtgaaggcaagagaatatgggacccagctagccacattggcactagcaggagcaaactttgtgcaggccctacagcggcgtcctggttggggtgcctgcaatcccaaggccacagaaggcatgctactatgctttcctagctccacggtccacgaagagcagtgtattatctgctcagtgggccccccgcctctttgtgtgtggtgactgccctcccccagtgagggcaaaaggccagtgtgacagcctttttgggtactcacacttggtaggttctgaattcttgtccagtgcccgataagaatgaggttacatgaacaaattgaaggacagtgaatatggagaattttattgagccatgaaagtggctctcattggagaggggagctgaaaaggggacaggaagggtgggtcgctctcccctgaagtcaagggcttcagaggctctctgcctctctccctccaaagtcaagttgcctttctccaacatcagccctcatctctaaagtcaagttgactctatccaacatccagctgcttctcctcactactggctgagtctcaggtctttataggcatgggatggtggggcagggcaggccgtaggtagttttggaaaaggcaacattcagttggtaaaaggacattattctgtctttgggacagagcaggcaaacaagaatagaagtttcactttgggctgcaggtttcaggctacttttggcttaaagatggggctttgccagggacctgcccctgtcagcctggaatttctctgccttttgcctctattaatatcaagcctgatgttttctcaatggtaaatccagaataaagtcattaatgtatttacttagattctcaaagataattagcttttagtggtatcattttggaatgcacaaccaagaaaaaaaaagttctactactctctaaatgtctagaaaatgaggtattttctatgagagaaatttaatgttcttttttttctctcctgacaacagtatcttacaaatcagtgccaaatgatgcacaaaaatccctaggtatcttaaagaggaaaaaattatgtaggtaaacagataaatctttagaacatttgtctttatgggagcaactcctgctgttggtctctaacctgtaggacattagtcttccctaaattgccaatggtgttccacatctcaatgataaatagaaatcactggaaaaaatagcacattcttccacagagaatttccagacagacataggcctttaagaaaaatgcatgcataaactagattattttccattgtggcacatttcacgctaggtctttacccacaagtcatttttctcagttgtacagaaaaaaaaaaaaaaagaaatagctttgagtaagacattacataaaagtgtacactaacatgattgtttatatttaagtggaacaagaaggaagattccacatcagagagcattcatcatatgtaatgaatgattaatcaccaaagactgcttttcattttcaaataactttagtagaatggtgtggctgtttgaagtaataagctttattcattatcccattaacatatttgggggaaaactatttacaacaactttcttctttatgaaatagtttcagatgacaaatttaatcatttacttttggttgcattgtgaaacaatttagttagaaatatttctcatgttttctaaaaattatcaacatgcttggatagacaattcagcatattttactctcaacttttgctatatataccaaaaaatattgcacaagagacaaatcaaaagtaggatggcggggtcggggttgatacagagaagtggagagagaggaaaaaaaaaacagctctataaattgtcttcacaaatgacaataatcaccacacatgggatcttagtacaaagtgccaacttttatcaattattctcacttttctcctcaggacatatgtatgtgaggtggcatcccttttgtctttgtgccattgcttttaaacaagtgattgcatgcttatttcacactctgaagcatagttcctgattgacttcatgtacctgtttatgaacaattgctgtgactgacctttggagccagatgctccataagttgccatttactttttacaaatgagttgcaattggcaatagttaatcaaactgatgacattcattaacaagacatcactgtttacaagttaatactattgatctttctcttagagcacatagttacattgagaattagcaattctatgataaagtcggtagagttgtgaacatttttagaagtctacttttatgtaaaattgaatgtttgttgtattgtttgtttacataagtatgttgaggtagatggattgagagagacagagagaaacaaggaggaagggagagaagaaaatgaagagaaaatgggagcatcaataaatacatgccaatgtctagtacctaaaaatcacattttattagtcctctctagctaagccaaagaacacccagaacacatctgtagcttaacaagtggaatttattacttcttatttcaaagggataccatacaatatcggggaaaattgtatgttccagtaaaagtgtattaggaaaaacatgctatatgatttgtgcttctattgggagattttactgatgatttgaggaagtgaggctttgctctgaattggatcttgtcaggaagcagagaaaacagtacaattgggtatcttaataaatcttatctagaaggaagaaacacgagaccaaaggtaaagccataattggtaaagaagcatgaatcactcacattatccagcgaggggataaacttggttatttttgtagttttaatgttttttctgagttcagacatggttacaatgtcttgattttaccttaatcctttgtagccacaaagtggacttgtctgatattgatattctgggccatagtttatgttcacaggagaacgccaaggcctagctgtgagggccttgccagctcaaagcaaaatcaagtcctggctgatattatcaggacaactcttggatgtcaaggactgctcttctctttctaatatttaagaaatattttctgagcacccatcatgtgaaacacggtgtattaggctaaaaattaacgctatttaaagaaagtaaaaaaatcaaaatatcgataagcctatggaacttacattgttatcattctactttacaatcaacagttcaaattattaaactgctatttttaagtttatgaaggtgtatgatcttagataatgagcccattccaattttgattaaaggtttaacatttaacttaatgcatattcctggaatatcaatcaacactctatccacaaaaaagtatcaattatgattatttaatttttaatatgtaaattgtatattaaaacatatttatccacatgacttttgaaaataactttaaagttacttatttagccataaaaagagccatatttttaagatttttgttacaggcaacatcacataataaagttaatccattatacatggatttaaagaagtgaatgcccttccaagaggtactagaataatataactagcctctattaatttactttcaatcctgattttcacattttatttaaagagtcttaaagtactgggtgacatttgaagatgacagaccataaatatgaattgcttctactatttttcaagtggaataaagataacttggcctcatatcaaaattcctgcattgatttcttgctctagtagaaatccataaatcaactaacattctgtcttactgaattttttttaaagttgatcataataatcccccttctagccaaatatgtttttcttaaggactaaatgagataagccatatttcagactgtaataattatcctctattaccctacaattttctcttaatgtccctctatcatcccttagtcttcacattccttaacgtgagagagtgtgtattgtgtatgctgacacaaattaggtgttaaatcagtgtttattgattaaaacaatgaatataataaaaatattttgcatgaaatacaacagaatttttgttttgattaccgcagtttaaaaggcatactacagaaagaaaaaataaccagtattttgattacgtaagtattgaagtctatttttctcaaattttcaactaacttgaatgatattaaaccaaacttttattttcccaccaattaactttacatagaaaattgactgatacagtataaaccaatttaaaagaatcgaaggcaatgcaaaacccttaaaatttgcatcgactaaattctgactatattttatgatcataatataaaaaggggcattttcactccttgcacttcaaaatgtaacaccaaaaattattaaaattaagaggtatatcaacaatactttagaagaatggaagaaaacaatgagcaaataagagatgttaactaacaaaggaagatcaacacatatgtcagggaaaaaaagatgtattaaaaatgcaaaaaaaaatcagaaaatatgatcaaggttaagagagagaatatgaaagatacaaaattttaaaagctagtagctgagaattttctgaaacagagagaaaacattaagttccagattcatgaactctatgaacatactatggaaataacagccaagtacattataataaaattacttaaaaccaaagacaaagagaaataaaaatacactcagagagcaaaggcacatttacttcaaagtatcaaaataagattaacaggctgggcatggtgggtcatgcctctgtgtaaccagcactttgggaggccgaggtgagcagatcacctgaagtcaggagctcaagatcagcctggtgaacatggtgaaaccccatctactaaaaatacaaaaatcagccaggtgtgatggcaggcacctgtaattccagctactcgggaggctgaggcaggagaatcacttgaacccagacggtggaggttgcagcaagtcaagattgtgccatcgcactccagcctgggcgacaagagcaaaactctgtctcataaataaataaaattaacagtcagtatcacatgtacagaaaaatggaatccagaaggcaaaggtgtcataatttctattctggtattagagtgcttacatacatgatggtgaaagcctaggttttttcctgatgtttaatgaaaagcaagaatgtcctctctcatcacttcgattcagcattatagtggaggttagagccaatataataagtcaaggaaaaagaaaaaggaaaggaaaagcatctaaatgggaaagagagacataaagctgtctttattcaaaaactgccttgtttatgtagaaaacctgaagaatctgttaaaaaattataactaataagtgagtttagtaagtgttctgttgcaagatcaatatacaaaaataaatttgagtatcagcaagaagtattagaaatttaaaataataacgtttaaaaatgattttaatagcataaaaacataaaatatttagggatgaatataacacaaattgcgaaagaaacttacactaaaaactaaaacatagttctgtgaaaaagtttttaaatacctaaatttaaaaaagaggtataccatgttcatgggttaaaatactttctgaaaataagatgtcaattttcccaaaatttacttataaatcaacacagtacccattaaaatctcaggattatttgtggaaattagctaactgattccaaaattattttggaaaggcaaaggactcagagtagccaaaacaaaacaaaagaaaacaaaaaaaactttaaaaagaacaaaattagaagattcacttcatctatattttaagacattttacatcttcagtaaccatgacagtgtacttgcctaaaagacaggcaaatacatcaattgaacagagtagggagttcagaaatagaatatatatattgtcacataattcattacaaagatgcaaagacatttcagtaggaaaaaaaaatattattttcaacaaattttcctgaaacaattggatatcaatttgcaaaaaaattgtgacctttgatgaatacctcatgctatacagaaaacttacctcaacgtgaatcatagacagaaatataaaacctaaaatatgaacttctaagaaaaaaatctgggttatgattaaaaatatgtaaatgaaatctcaactcttgagaaaaatgttaaaaagagtgtctttagatttcaaccattcgtagacagggcaagagggtaaaagtaattttctgagcaggcactgaagatataattgtatttgtcacagactaaaacaaacaaaacaaacctttttttcttcaattaagtgctttctgcattttttataactatctactaaaaatgcatgactttttctcaacattaggtaaagaggcataaaaagtaccctgcaactcctgagctcgtgatccatccgccttggcctcccaaagtgctgggattacaggtgtgagccaccgcacctggcccaacatggtgaaacccagtctctactaaaaatacaaaacttagccaggagtggtggcgggcgcctgtaatcccagctactcgggaggctgaagcaggagaatggtgtgagcccgggaggcagatgttgcagtgatgttgcagtgagctgagaatgtgccattgcactccagcctgggacacagtgagactctgtttcaaaaaaaaaaaaaaaaaaaaaaagtagtctacatataattttctgtccttcactctcttttctattttctctcctttccacactctcttatgattgccatttctaaaatccctcttatgcaaaatttctggaatcctcattgtctttggcatcacgtaacttgaatagaaattacaactcaataaatagggctaagatttcttcacagtagatttttaggagtatgaaagtgggatttgggggcagataaagaaaatcgtttgaaaactatatttagaaaatagagttcatttattccaattttatactattggggaggtctttgtcagcctctgaagaggatgaattaagaccccaccttcaagcctcttcttggcactgccttttattggaatatattagaggaaatattaagctaagatttaattaatggtagtaatgaagaaaaattgggtagggtgtagagtgaggcatgttaatatatgttaaggtaggtccctggaagagaaacagcagataactggaactactactgcactgtcactgcgcaaaagctgttttttcctcaactattgtccatgatccttcccttaagagttgaaatctacttataagactcctaaggtgtttctttcatattgcttccattttattccctaaatcaacattattttgaatattaaatgatatgtttcatttgaatgacaagaaaacaggcccctgctgctgatgtctatcttgatatgaccaaaatatttctaaacacacacagaaaaacaatctgagtcttaataataaaactcaagtaataagacacaaagttgtaatagagaaagacatcttgaggctttaactaataatttaaataagattaaaatattattttgaagaagagattaaaagtttacagaaatgaaactgataaaatgtacacacacataaacaaacagacacctcagaatttcattaaataaaaataaaattttcaaatcggtacgttcagaggccctatgaactagattctatcattgagattctttttctttcctttattttcctcttataaataataccactttgaaattttagactttaaaaacatctgagatttgtaacttttttattttaatcattaaatactttatcacttttctttttaatagaattatttcaaataatgtaaagcttgtgattatactacttataattttcttcaaaagacgttttaaaagcagacacatcatttcagtttgtgttgatttcagagagaaatggaactgtggcattaaacaatttcaggttggaagaaagtttattgtacacacattatgtggagatttgttcagaaaaacatttgggtatcaggcttgtatagcacagccaggcagagaaaggatccaaaaagaattgaattgctgaactagcaaatatatactgaaatcatcagataattaaaagggcttaaacattgtcaaaaacaagttaagaaaaaggctaatgatttcaaccaacttagaagggtcaagactgcttaacagtgcaaggaatgatgttgaaacttcaaacatcattttccaatcacaagccttgtgatcttgccacttaatcatgtaggtgtaatttttttaagtgcaaaggaaacgattaaatgtttaaagttgaaaattaaaacagaaaagtaaatatatcttactgagattcaatatataaaattgctgaccatatgataatgaatgaaaaaaactataaaacatgaaataactcatttgtaaaaatcagtttatgccatggtattggatttagcacacagttttttgtttttttgttttttttgagacagaatctctctctgtcgcccaggctggagtgcagtgaagtgatctcagctcactgcaacctccgcctcccgggttcaagcgaatctcctgcctcagtctcccgagtagctgggactataggcgcgaaaccccaccccgattatttttgtatttttactagagatggggtttcaccatattggccaggctggtctcgaactcctgacctcatgatccgctggccttggcctcccaaagtgttgggattacaggcctgaaccacagcacccagccaagcacacagtcttaatataaatcaaatgtgtagtgtgataaccaaatgtcaaaagataaagataaaactatacattctgtttctatcactcctatctgcccatgacaagcctatctttttggttcaacattattttcccctggtattgataccttcctagattcctctttaccaaataacatttctttcaggccaaatttggattagcagataaaaggacaactggaggcttgtgtaaaacagagtgctgcctttctacatagtatttaaagaggaaacataagatgaaactctaataccaaattagtcctcaagtgacttttaaatatttgattatttttggctaataacgatatcatccgtatttttagatctggacaaaaccagagatgtgttcaggacatttgactgtatgtattaagtcctttatttaaatattattgagagtttgtgttaatagctctgcatccaacaataacaacaaaaacaaagacatagaaacaaaacaagcctgtgaatctgaacactattctttacgcagtacctatgtttcttgcctcatgcatctcatgtcttctgaactgcttacgaagttacagtcactgtgtcctctggatatttctttgtcaactttaacagttgtgtggggtttctttcgtagactttatttgtagagcagtttttggttcacagcaaagtggagcagaaggcacagagatttcccgttttcatcctgcccccaccggtgtacatcctcccatctgtaatcagcctcctccactaggggtacatttgtcacagctgatgagcctacactaatgcatacatcattatcacccagagtccatagttatgttagggttcactcttgacattgtatattccatgggtttggacgaatgtataatgacatgtgtccaccatgacagaatcataatgagtaattttaccaacctaaaaaccctctatactctctttgttatctatttctacctgctatcacctggaagtcacagacctttttactatctctctagttttgccttttccagaatgtcatataattggaatcgtgtacgtggccttttcagattggcttctttcacatagtaatataatttaagtatcctccatgacttctcatggcctcatagctcatttctttttagcactgaataatattccactgtctggatgtacctcatttattcatcacctactgaaggccatttcagttgtttccctgattaatttttacatgatttctcaaagagcaaatacttcagaggttcctggctaatttataatattctgtccactaggacaactaagttgaagcaaacataacctatagtgaatactccctcaaaggtaattactattctaatttctatcaccatagatgggttttgcctgttcttgactctcatataactgaaaacatatagtatgtaaacttctgtaactggctttttttcctctctctatatatgttttgctctacgtgatggctttcagagtggtacatgttactgcatacgggaatacttcattcttttgattactattagtaaggattatggggttaactttgggttattatgaacacaactgttaagacttttaaaacttatcttttggtggcagaaccactcatttctgttaggcatatacctagagcttgatttcctgtttcatatgtctacacattcaggttaagtagacactgccaaatagttttttaaagtagttacataaatttagatactcactagcagcatctgagaattccagttattctgtatctttaccagcctttggtattcgctattctcttaatggtatgaccctggaagtcgaataatacctcattatagaaccaattcacatttccccaatgagtaaagattttgagcaatttttcatttgctcaatttatttatcggcctttgcaagagtcttttttgagaagcatctacgtgtttactttttactattgatttttaaaaataattttacataaaaggaaaggccattctactattgagtgggcttattagcatgtatgacttatattgaacctcaagtacagtggatgggaaataattgcagataaatatgttaactggatactcacaatagcacaatcctttcatctgacttttcaggtaataagtacataaaaaacaaagcctttaatttgaaaggttcgtagctgatgctgcaggactgctttgtgataaatatgtgctgggaaatggacacaagacaggattatcaggcaaaattaatggtatttgtgtcccagctgagtcataagtattaccagattcttgccaattatttgaattaggttggataaagatgggaaaatccataacacaattaaatagcctttagactttcccttttttttctctactctagaccctcttatgtctatactttgcatttcatcatcaacttctgtctgagaataaattggtttatgcccaagaatattaatctggtatatattttgtctgacatccaaacattatttacaaggggaagcatcaatgaataagttagtgaagtatgtaaaatcctgtttatgctgaagagcccttttcataaacgagattatggaacacttgtattattactaaattaaattaattaaagcctatcatccttactctagttcaatcatttatttaatgcacacagtatgtctaatttatgtattataatatattccccaaaatgaagaagcttataattaatatctgtcatttttggaataggaaaaactatttaggtctaatatgaaacgtgtctataaaatgagaacagtgattctgaaaatcacagagtccaggtcacttatagtcaatattttttaattaaaaaaaaaaccacttgatcttataatctgactaataagaatatattatgaaggaagacttgcaggcatgcagatatcattatttatcatataaacttaaatgatatcagcatcaaacaaaagtatgatagtcagataatttatattgtatccagaatacgcagttttaaatatcactaaaagtaatagcatgtgaatacatgttaagtgtatttcaggataaagaatattttaattagaaatatatatatatatataaatgttttttctagtttcttaattaatgaatttatttatagataagaaatatgtatattctcgtgacatgccttatgtgctggcattattgatgataactgtttcattcattgtatattacatatttttgaaataaatatgatttactttagtcatcaaaacagcatggcggtacatataatctgtaattttcctcctaacaacttgtttttaatataatttatttcactttaagtttatatttttctattattttgtatttacaagcccacaactaatatcataaggtttatatattttactttttattttttaatttttttcctcaacttttgagttcccgggtacatgtgcagaatgtgcaggtttgttacacgggtaaacatgtgccatggtggtttgctgcacagattattccgtcacctagatattaagcccagcatccatcagctattcttcctgttgctctccccaacccctaccccctgacaggacccagtatgtgttcttccctgcaatgtgtccatgtgttctcattattcagctcccgcttataagtgagaacaggtggtgtttgcttttctgtttcacatgagtttgctgaggataacagcttccagctccattcatgttcccttcaaaggacataatctcattactttttatggctgcatagtattccagtgtatatgtaccatattttttttatccagtctataattgatgggcatttgggttgattccatgtctttgcatcttattttgtccaagttaaatgtccaatttatattgtgaatagtgctgcgatgaacatacaggtgcatatatatttataatagaatgatttatattccttttgatatatacccactaatgagattgctgggtcaaatggtatttctgcttctaggtttttgaggaatcaccatgctgtcttccacaatggttgaactagtttacactcccaccaacagtaaaagcattccatttcttccacaaccttgccagcacctgtttttttttttttttttttttttttttttgactttttattaatagtcattctggctggtgtgaaatggtatctacttgtggttttaacttacatttatctaatgatcagtgatattgagctttttttcacgtgtttgttgaccacatgtatgtcttcttttgagaaatgtctgttcatgtcttttgaccactttttaatgaagtggtttgttttcttcttgtaaatttgtttaagtttcttgtagattctggatattagatctttgccagatggtgattacaaacattttctcccattctataggtggtctgttccttttgctgtgcagaagctctttagttcaattagatcccatttgtcaatttttgcttttgttgctattgcttttggcattttcatcatgaaatctttgcccatgcctatgtcctgaatggtattgcctcgattttctactagggtttttatggtttgaggttttacatttcagtctttaatccgtcttgagttaatttttgtataaggtgtaaggaaggggtcaaatttcaattttctgcatatggctagtcacttctcccagcaccatttactaaatagaaaattttttccccattgcttgtttttgtcagaatttttgaagatcggatggttgtaggtgtgtggtcttatttctgagttctctagtctgtttcactgatctatgtgtttgtttttctaccagtaccatgctgttttggttactgtaggcttgtagaacagtttgaagttaggtagggtgatgcctccatctttgttctttttgcttacggttttcttggctattcagtcatttttttggttccatatgaattaaaaaaatttttttttctaattctgtggagaatatcaatggtagtttaatgggaatggcattaaatctacaaattactttgggcagtatggtctttttcacaacattgattcttcctatccatgagcatgaaatttttcccatttgtctgtgtcctgttggatttcctggagcaatggtttgcaattctctttgaagaggtccttctcgacttttcaatcttgttaaatacctaatgtattttttctcctttctccatctcattttgtccagtttaaatgtcattaaatttcaaatatccaatatgaaagtgatgctgtctaccacaaaataaaaaatataactgttaaagacactagggatacaataagaataaaatgcaattcttgtcattaaagaaatcttctaccttagacaaaggcatgcaaatgggtaattacatgtcagatatggtaagttgtgtaatagtatatgatggcacaatgcacacgtgttacggccgcataagctacctcactgtaggaacatagtgagatatatctataaacctgtgatgacatttgaaatggttcttgatggacaaatatgaatttgccaggtaaagagaaaggcaaaggacattgctggaaaaactggcaaggtaagctgaggcaagggcaagcgtaacgtgctcagagatatgtgagaataagtagcagaataagaatgttttaaaaaagagagacatatttgactatttaagtgtataaatatatatacttccataattatgcatatataatgagataaaaattttgaaatgaacttctagatgtattactgaatgagaaaagttaaaagtagaaacatatatgcaatataattttatttgtgtaagattaaagtgatatatggccatatatccatatatgaatagatgcatatataagaaaataaagggtaggatgcatgcatatcagcgcaataactttgattggacacagaggatagagagtaagaaagccacaattaaaataatgagactcattacaaaatgtgtttatgataagagacacgtataaaataattccaagttcttaaaaattagaatagtcataaaaaggtaatgataattttctctttatacttttaataaattaaagaaaaaaataaaatctattctgtgccgactcaatacttgaaaaatacagctcatgaatatcttagaggttggaagtattatttctttacatctgcttatctctttctatgcaaccactcaataaaatcattgagaatatctgtcattttttgagaactggctaattttcaagcttttatataagcaaaaaaactcaattaaggacttctctctgtttctgcttgataaaattaaactgctatttacctagtcaaatttttgcattttctaccagttagtttctttactttaaaaaaaatcaaatttattttagatacagggagtacatatgcagatttgttacgtgggaatattgcatgatgctgaggtttggaacatgaatccagtctccctggtagtgagcatagaacccagtaggtagttttttaggccacccaccatctggtagtctacagggtctgttgttcccatatttatgtgcatgtatgcttaatgcttagctcccgcttatatgtgaaaatatgcagtgtttgttctctgttctggcattaatctgcttaggattatggcctccagctccatccatttgttgctgcaaagacatgatttgatatttctttacatttctacaagcttgatctatcctcaactcacttagtgtctttccgttgtgattacaaaatgcatcatgactcttcctataaaaatgagaaaggttttcataactggtcattttatttgcattgacttatttgattgaccattgaaaaatgaactaaagcttgtttacactgaggtgttatctccaacagaaatatgcattttgtctcctctaagttaactgcatttcagagatctgaattagatcagaagactttgtaattgaatgggaagaattcatctgcattgtttttatctggcgtctaccatctggtacttgaatgcaaaatatgtaaagataaatgacaaaagttttatggattttacttgttatttgttttagctgtgctgtactcaaattttgataaattatgttttagttgcatttttattatgttgtagagatgacaaagatcactgtgtacacacaaagagttcaaatggttttgagaagattgctttccacatggtacaaaataaagaaaaaattgtcactatttggttaacatgactgagaacccaggtacatattctaggctttatttatacttctgcttgagttcttaccagggatgtcactggctcatatagtatctgtatctggatttaaaaagcatgtcacatctgggctgctgcacagcttttgcagatatgccaaatatgtacagcactgctacctctttcaggttgatgctaccctctgttcaggaccaaagcttggtgttgttcattgatcaacctgtacacaaccacccagagaccactcttggcatttttgacagtctagtaatcaaatgtcctctctcgcttttattatttccccatacacacatttgtaggtattaaccaaataaaataaacaaaaaagttgttcgtgtttcttttttattggagaatttttttaaaagaactgtaataggtaacaagacatgctagggtttacagaaaaagaaaacttctggcacagtgaaatttttttttcaaagtgttagttgacctcacttctaaatccagtgcccgccctccacaaaaaagttacagtatgtgtattgttaggaagtgtttttattgatacataatagttgatccataaaatgtatgggatacatgtcatattttgatatatgcatacaatgtgttatgatcaaatcaaggtaactagcatacccaacacctctaacatttactattgcatagagttaatgataattttcattttacatttttagtaaattaacaaattaaagaaaacattccaaatcttttatcatagctatttagaaatatactatattattgtaaaatgtaatcaccctattttgctaacaaacactacaattcatttttttatcttaactgtatttttgtacctattaaccaaattttattcatcccctccttcccctacctttcctagcctctggttaccacaattaccttcataatatcaattttttaagcttccacatataagtaagaacatgcaatatttgtttttctgtaactggcttatttcatggaccataatgtcttccagttcaatccctgatgctgcaaaattacaagatttcattcttttttatggctaaataatatttcactctgtatttacagcacattttctttatccattcatccactgatagacacttaggttgattccatatcttgaatatcgtgactaaggctgctatagaatgtgagtgcaggtatctgttcaatatgctgatttctttccttttgaatatccagcagtgagattgcttgatcatatggtcattcaactttcagtttttgaggaagctccatactgttttatagttgctctactaatttgcatttctaacaacagtgtatgactattaccctttctcctcatccttgctagcatctattattttcagtgttttgaaaacaaccattttaactggggtgagataatttttcattgtggttttgatttgcatttctctgattatcagtgatattgagcattttcatatacctgttggtcacatgtatgtcttcctcttttgagaacacttacccatttttaattggattttttgttgttgtttgagtttcttatataatctggtcatgaattccttgtcagatgagtaatttacaaacattttgttctattctgtaggtcatctcttcactttgctgattgtttcctttgtatgcagaagcttttcagcttgacataatcccatttgtcaaggttttacttttgctgctagtgcttttgaagtcttgctcaagaaatctttgcctagaaaaatgtccttttcccccaatgttttcttccaatagtttcatagtttcaggtcttacactaaagtacataatccattttgattttatttttatatgcggtgagaaataaaagcctcatttcattcttctgcatgcagatatccggtgttcccagcaccatttgttagactgtcctttcccacatgtgtattcttgttgtctttatcaaaagtaagctggccataaatacatggatttatttctggtttttctattctgttctgttagtctatgtttctgcttttatgctggtactatgctgatattttaaactgatattctaaaacatttcctagctcatggaagctgtaacttcccccatcactttttggttcagaggaaaagccacaccaccacctgtgcccccaagtctggctaatttttatattttccgtagagacagggtttcaccatgttggccaggctggtcttgaactcctggattcaagcaatctgcccaccttggcctcttaaagtgctgggatccaaactgctgagcgaccatgccctgccaccatctcacatttatctaatgataacttgagaaaacagtatgttgagttcttaaaagtgatcaattaatgttaaagtataataattaaggggaatgggaacaataaaataggtgcctttttatttggtattaagtgccttcagaattattttaaattgaaattcttcatttaccatttgctacaagaagggaagtatttgagtttaagcttacagatcacatgtgttctaattagtgtttatcttaataaatcaaacactaaaaccctctgaatttggtaaatgagaatttctatgcagagagaaataggtagactttagatttttcttattccctcagatttactttacttcacagaatcagttataaatccagcacctttatatgacatctatggtgcaacaaggatcagattggaacatttttaaaaattgtccccttaatgttagttttcttctccctgagaagaatcataaccttctagtaaatttaggagagtaatttcatttcaacttcactcccaagttgctcactgagctgtatatttcttccctgtctattatgttcccccacaaactttgggagtgtggaaaaggagtgagtgcaaagaagacctcaactcattctatggcttcagtcttgcgttcatcaaaccatcacctcagaaagctggaaaggtaacttattctttgctgaagagctagaaaaactaaagaatactataaacatgagagaaggcatttcaattgagcactaatagtattttatattttaccatctatagcagaactattcaaagacagctttttctttttttctttttttatttttattttatttttttgagatgggtctcactatgttacccaggctggtcttgaactcaacctcaagcaatccccctgccttggcctcccaaagtgctgggattgccaccacatcctgccaaagacagcttcttatttttttttttttcggacagcccagtgcctagataaattacaaatccttatccaaaatctgtgatccaaaattcattaaaaaccaagtttttttatattatttgtacattgataaatgatggaagtggatggggaagctatttatagtctttatttatacaagtttgcatgcatattcatacacttcagtacataaatatttatagagttgattgtagagtgctcccctaaaccaaactggatatgttaaacactatatggtgtatcgatatgtgttgttccaaaaatctgatacatcctgaattgcaaaatgaatctgatctcaaggttttctaaccccaaggcatcagggacacacacacaaccctttctcccccagaaatatcctacgctgactactatttttaacatttttatttatattttgataacacttttgctgaaccattgatttttgcacactgctgagaaatatatgtaaccaaatctgatttactcatttgtaaatagcgtttggggacaacagtaggctatcacatagtggccttgatatttaaagtcctacaggatgagacaatgccagatagtgaggagcaaaagatgaggaagccttgtcatcatgaaatctacacaatactagttacatagaagatctgaaattgcggtttcttttgaggctcgctagcaacaaaaatcgcagctgtggttctgtactatataatgagttcggctaataaccattgggtcagacatgcatctgcatttcatccaaaggctgacgttaattttcagtgatagtccactgtaaagtaaaagagagaagagttgcatttttccaactgtcccataatttgtaattaccaccaactgttttaaaattgctgcttaagagctcacttaaaagtcaggctcctacccagttaatagaactgggtgggacgattgctggaatgggtttgttaactcttccagttaataaaacacaatgttttattaaaggttgtatggtaaaaagcaaatcactaccacctgtcaactgagtgaccttggacacgttatcaaatcgctttagtacttccatctcttatatgtaaaattaggataaatatacctttcctatgaaatataagaaattagtataaagacaatataaatataatttatatgcaaaatatattgcacagaataggagcttactcaaacaagttaatattatgattcttaatcattatttattattattttacttataacccatgattttttcatcaaattaaagtaaagataaaattagagatggtcatgaaaacttatttcatgaaaaaaattatgtttaagttaatctttatttgtgtcctaaaggtttattgtccagtttcaattttaatgaatattgtttaaagctgaaatttttctttagtctcattactctagtactgtaagataacaaatttgggttgtttaatctgctagatttgtgtgtatggtaatttctaacaacatacataaacacaaaatagaagatcttgatctgatttataggcccctcaaaattttaatattctcttttagagagaagagaatcattttgtttggcaagatgtcttattatttgcataagtgtttatttacttaatcaattcacatgacccaaataagtgtttgcacttcaaatagttaatacgtgtcatatctactggtacattgaactcaaaagaaagactcaatgatagagaagtattacgtgaattgcataatgtttaggctaccaaattttagtgtccatactcttctgttaaatatttgaaatttagattttgtaagccctaataaaagaatagcagatactgatgggaattggagatgaggtgagtttgtctggatggccttagttctagtataagatttggtgaattttttcaaaagtgacataaattatatttctcagaaataataaaattaattaattgacttatgatctttttcaggtttattctttaaaagaataagtgtatggtataatatttaaatcagtacgagaagctgtgtaatgaagactgaatgaccaggttatcaccttggggagatagatcagtgataacacaaaataagtcattgaaacaactgaataagaaatctcattaaattaatatgattaattaatatagattaaaatatattatgtgaataactgctgctagaaatgaaatgaaactattgatcattaaacaatgatgtcaattatttatacttgattttgcaactaatgacaactaaatgtttattaataaaaatgtgtattcatgtgggaatttattatatctttttgagcaaatgcttgtgagtgaaattttaggcaggaaatttattatttgtttcctcataaaggcaactattaaatgcacttctgtgttttttgttttgttttgttttgtttttttgtatcactctgtagctcagactggagtgcagtggcaagatcacggctcactgcagcttcaacctcccaggctcacgctatcctcccacttcagcctcccaaacagctgggactagacgcactaattttttgtagaaatagggttttgccatgttgcccagacttgtcttttactcctggagtcaaaaaatccacccacctatgccttccaaagtgctgcgattacaggcatgagccactgtgtccagcctgtgtttctaaaataagttcgtaactgtgaattttgagagaactgtccgcacaagaccacccttacttctgacaccagcttcaagtttggtgacttctcaaatccactgttgggttgaaaaatttactagaaagactcacaaaacccctgaaagctgctgtacccgggcttatgtttcggaaatcagattaataccagtcaagtgaggaagcacataggcagaatccaggaaaagctccaaacataaacctcccacgctccttccctattagagtcgtggacaacgttcctttcctggcagtgatgtgacaacacacatgagggtagtgacagccctggaaactgacccaaatcttgctctccaaagtcttcattgaggctcaaacactttggcacagttaactacccacaagactggtctccgtttccttcccctccgaggtccagctgatactgcttcacaggaccacatcctaaatcacagtgttagcctcttgctggtcgaaagtcttcaggcaaacaaaagttctcttatcaggcatgacgttccaagggcttagacattacctaccaaaagttgaggacaaaaaacatctcattatggtcaaattaaattatttactacatattttgtaatatatatattaaatttacttatcacacttatatttcacagtgtacacgttacgacaaattattaggtactaagcaaaccactactccggttaaaaaatagaacattgccagcacactagacaccccattgtcaccctctaaagagcacccttgctcttctccccaaagaacccgtggcctatatgattaaagaaaactttaaagctacgtttgcatatttgtttcttctggaaatccaatcatataccattaattatagctcaaaaatgttgaaaaaagctacaattgttggaaataatagaaattttaaaaagtcaaaatgtattctgaagttagctgaaatgactccaaattattgtaaattttaaataaggtaggagatgtactttctattttatatattgaattgctttctgatatcatttcagatatctaattttcagaaatctagttactttgagatagtaagcaatgttttttactaataaatatgtcaaatgaaaacacaaggtctcacaaaagaaaacagtatttgtaataatcatctaaataattgtttttacactgacaatccaaagtctgagaagtgtttcctgcctacatcaagcttccaatagcacatttctgtaataaaaatatcacatttttcttataaaatatctctaaatgtgatatttgttttatagggttatcattttccagaaatagttatgtataaaaatatttaaatgctcagaatcaaatgaaagaaaatagagaattttaattggaaaatgaaggaataagatcctttgtaagacatctagccaggaataagacatatcaagtatactaagaagattaattattcagcaaatatgttgaaccaagctaattttccaggaagagttaatctaattccggttttggcaaaaaggtgtgtgtcaagaactctgaaggttctgaaatgctatgttactttaaaactaacaagtcggactgtcacagtttcgtaggtgctggcagaaggaatgagactccgaggtcaaagataaagaactttattacttacagcacagcagacagcaggagctcgtgttcatattgttttttcattgcccccaaagtctcttggagaagatacaggggcagccctgtagatgctctatgggcattgattttgtgtcattgctgaggaaacttgaattaaggaaatctttttttttttttttttttttaaagaaggttgctagtccccctgtcctgccattgccctggctatttcctatacaatcatctttggaaagataatctggatcaaaagaagtgaagaaatttcatggtaaattgtcactcaaaggtatggagcatagcgatttttcagtttgaaaaccacaaaattagcgtgatttactatcttactgaaagataataaattatttacaagccaagaataaaagttaagacgttttgataatttctaaaaacattattataaataaatgatagaaactattgacagaaactattcaattcatagaaagtgttgatataaattatttttgtaaaccaaatacattttcacattattatggctactgaagaataacacataagtttaaataactttgttatgacatcatcgaatacctatacttttcctctaaccaaaatctttagtgatacttctggtgatattttgcacttaagatatatatgcagtttgctaaaaaaaaaaaaaaaaatcaagagcctcaccagctagccaaagttaatacatgtatgtatacatacattcacacacacacacacacacacacacacacacacacacacacacgcatacacatacacatataatctacagattggggaagtgataaacacattttacttaagtgcatttttttttttagttactgaataagggtaaaactagagaaaacttttttcatgaagtattttttaaataatttaaatggtagcatatttaaagtagaggcatctcattaagtggtaagatattgctgtgttataaatacataatttacattctaattaaaacaatcttcaatttcgtctaagggcactgagtcacatgtcactgtcatattgttatcattctaaattaggggctggcaaatcacaacccacagcctgaatctagcctggcacctatttttgtgaactccaaaatgaagaacactttttatagtttgaaggctcaaaataaaaacactatttgatggcatacaaaaactataggaaattcaaatgtcaatgtccatgttttataggaacacagccctggtttttcgtttgtctctttgggttaggggtggggttcattgtttttcgtagtgtctatagctgctgtgcatgatagtcaatggccatcttgaatagctgtgacagaaacatgtggccctcacagctaaagtgttcacaacttgaatctttacaaaagaagtttgtctatcgtagccttaaaaaaaattctaactatggaaaaaaaacataaaaatctgttcttgtgtagttatataaagtgtcacatgggctctggagtaaagaatctttagaagaaatttctcacagaactaatcacaggtaaatacatgaccaaagagagatgcaaaccattccattcattaatccaaaataataaatgaaaaataacccgatggaaatatagcaactatgcaaattgtcctaaataagacattaagaaaattttaaataataataataataatagaatcaggtttagtgctagaaatattacgcctcatggtttattgagatgataaatgcaaactattgaatacaaggattagacttcagtaggaacttctcccggtaacatatagcacaaatgaaaaggacagtggaagtgggaaatacaaaatatttaaaaaatgttttaaaatgaatacagcccattccttcataaactagtatatatttaattgcctctagaaattgaatataaaatatagcaaaatatctttttataattttacttagaaattatatccacaattgattcaagaaaattttacattgctagaaaagagaaaaattttacaaattatgttgttagtaaataagtttggtatagtagtaaacatccttatcttcaagaaaaaagggttattgagagttttgtaggttatgaaattataggttgaaataaggtaaaaaaatgaatagctgatgtgaaatttacatatagggaaaatgtggtttaatgtacaataaggagtcatttttcttttttgagctgtcaggtgtattggaaatcaactagctcagctaacatcactttagagatgaagcaactggagattataaaaatcagtggcaagattgggatgcagtccttttgacttttatttttgctgcacaagctgccgtgaaatttgacaaccattttgtattgcttctatttggtggaatcccttaattcctaatacaacaatttaattacagttatttctttatcagtatttttccagctaattcaatttaaactttattaatgaaagtttatccacttaggtagataaatattaaaataaaataaatatgtgacctaattactgcattatctctctctttacaagtaaataaaatgtttatccatagcatttcctctgattgaattccatggtgtcatttctcatgtttaaattactcaagcttgttattgccattttttaatacattatgttatataaggcataaaatattcaaagaagaacctaaactacaaaattaaaaagtaggtaatagaacatgactgattgatgtagcagagtaaagtatattttcacatatttatatttattttaaaaataaaattttcaattaacgaataggctcagtttattagtagacagacacggaaagtcaaaaggcaaaattcttagcctctttttcatagtattaacttaaaatgagaaaataaaaaggctgaatactatttaaagacattaatgtaatattatcagtcatactgaaaattactaaggggaagaaataacagaaagatgctttggccatcgaaggctatctctttatcttatcctgggtgaaattgcatgcatgatttcatttgctatcaagctttaaaactttaagtagcttttcagtgccaaaatttcaaaatactgtgtgtatggtgagtcatttgatgcaatatatttacaaatgtattcttcaatgaagtcatacgttaatcatacaaagttcttcagaactgaatgggaaaacataaggaccgatttgtctgtatgatgttctcatattcgatattcttgattttttgaaatattaggactttagattctatgaagccattagatttccacaattgcctaattattgagtgttctcttcactgtagggtgtgtgtgtgtgtgtgtgtgtgtgtgtgtgttgtgtctgtgtataagtgcatgtgttaagtcaactactaagttaaagctatttccactaccagcattccattccacttggtttaaatttatttcataccaaaaaagaagaaatgctatgaaaattcagagtgataaaatgactagtctaccacatagtgcagttatgtgttggcctttcaaatttcctctcagacatgacagtttttaactcaagggagatataaaatatcataattaccatgtagcaaggtaaaacatattctgcacttcgccaaagcatgcctttaattcagttaggagtatacatattcaaaaataaaatttgcacatataatgaaaggggcaatattgttgtgatctaggtgaaaagggactaatgaaatttgtttatgaaaatgatggtcaactttttaaagaagcaattagtcaggactcctgtctatccaaggtacaatgtctattttgtgttcaaaagccataattatttcaaaactaggcattggaggaaaccagataattagtctagtacagctggtgtaaaacactactggcagaaacactgatatcattaaaaatttggcaaagtatcttataagcaatactcctgggaaaatgaaacaaattaagcacctaagtattttttttagaaactaagaaagtgtttataaaggacttccgattttgctgctatattaaaaaggccttggcaacataaaaagtaatccaacgttacttgttttgctcatttgttaataaaaattatcttacatttagtttgttcggaattgcactgttttattctttcaaaatatttttctttgaactttttttctgagtttttgttagttttgtttatattctttgtaatctgcatgcttattttcaaatttcaattttatttctttaaaaataacttactataaaatatgtctactaaagatggtgtaaaatacatttatagtttaaagaataacaataaaataaatacttgtgtacacactaacttaaaaactagaatgttaatgaagatttaaggtcctctgtgtgccttgattacatctccttctctccaccctagaataacagtgatcctgatttttgtgatttatttttggctttatttttgtgatttatttttggctttagtctatatatagatggctacaaatacatattgttttgttttgcctgtttttaataccaatagtgttgttcagttttataattttcagcaaatcaaatttatctacatcatatttttctgtaatttgtagaatattgtctgttaaattccatctacttgatattccatgtgtgctgaaaactgtagctgtggataacacatttttcagtgctgtagcatgttcaattgcaaaaatatccccatagtctatttattcctcatatttattcctcatttgtgatttactcatttctcgataaagggatactaatatttttggtggtccaaaagaagatatttggatttgttttatttttctcgttttgtttctttagggttattctgttataattgcaataacttcttaaaatgaaagcctagctaattaattttagatgtttctatattctaaatacttatataaatacatgcacacatatatacaaatgcacacacaaacaaacatacatacatatgtctctgagtgtgtgttcaattgcattttatctccaaaccccaaatttcacatttagtatttgttgtggttattatttttccaaatattttctaagtctcactatgctttattgaatgacatataacatatatttagtaaggttttcatttctcaaatatattgtttttggggagaatgggttgtttgtttttactgatttacaacttattttattgtggtcagctggtgaaaagttcataacagacctttctcttttgttaaggcttaatcaaagacttagcagttcttggctattttttcaggttcttaatttatttttattgtggtaaagtacacgtaacataaaatttaccattttaacaattcttaagagtacagtttggtggctcaagtacatttacattgctgtgcaactattaccgtggttaatttttttatgtttcttatcctcacaactgctatctacattgtaaaatgtgtccctgagaacatcctggctaattctgttcaatttgtttaatttttgttattgttgttgttttgagacagagtctcactgtgtcacccaggctgcagtgcagtggtgcaagcttggcttactgcaatctctgcctccagggttcaagtgattctcacacctcagacctgcaagtagctgtgactacaggtgtgtgccaccacacctggttaatttttgtattttttgtacagatgaggtttctccatgttgcccaggctgatctggaactcttgagttcaaatgatccacctgccttggcctcccaaagtgctagaattacaggcatgagtcaccacactcagcccaaattgttaattcttttggattgttatatttagttgatctatcaattactaaaagaaatgtattaaattgtgcaaaatttgttaatctctccatatacttctgttaatttttgctttataaaagtcatgactatatttatcacagaaaccgtccctgatatttgtctggggcagaagtagagggctgtatactatacctaaatattaaaatgcataaatgtaacaaataagctcttatacaaaatattttctatccttctcccttgacagattattacattcttaatgacctggaaaggcagagaaacttttaaaattcttggatttcatgaagtttctttctgggaagagggcctatgaagagggtcagatcagaccgtgaaatctggtctctgtcccctttctctttcttttcaccatcagctccacgtcacactggctgttcactcacgtagacagcacagctttggctgcattccacacctgcttccatcatagtgagtcctccagaagactgaattaatagagaggccacttggccttggaatatgacctagagaagacataaccagtaggtggttgtgagtatggacatgaactacatttaaggggaacctgttggcccagtggactctgttcacctaatagagtaaaggtcattgtagaggagagacaagtcctccaacgcacatgcctgaggcttgcttcccttcttcagtcagtctaagcatattactgatttgaggtattatacaagttcagaaatgcatatcatcttgataagtcaaacatctgaattttatagtgaaaactgtattccatgtaatagttttgcctttatttatattgcctgtcatagttaaagctatataaagatttattaaaaattaaacatttgggaggctgaggcgggcagatcacgaggaggtcaggagatcgagaccaccctggctaacacggtgaaaccccgtctctactaaaaatacaaaacattagcagggcgtggtggcgggcgcctgtagtcccagctactcaggaggctgaggcaggagaatggcttgaagccgggaggcggagcttgcagtgagccgagatcgggccactgcgttacagcctgggtgacagagcgagactccgtctcaaaaaaaaaaaaaaaaaaaaatatagatctatctatatatatatacacacacacacacacgcacaaaaattaaacattactctatatatcttttctcacccttctgtatccttatgccttagatgtttcttatgcaaataggattttattagacgttttttgtaatatagctagacaattttgcccatttacatttattatgattatggttatttgtagatttaaatctaataatgtattatggaatcatatttgtcactacactcttttataaaatttttcttctttcttatttgacttcttttggattaatggatttttaaattgttttcatttatcccttcttgtgtgtacattttatagtttatatgtattctttttgtgttcacagttttggaacacattaaataaagtctaatgttattcaaactctttacctgctcgtgggggatcccaggtcaattgaggtctgttcccaggaggattatggctgcctctgctgtgtcatgcaggttgccagggaagtgggggaaaatcagcagttacaggcctctcccagctcccatgcaacccaaaaggtcggtctcacttccacagtgacccccaatagcaccgagtttgtcgccaagcagtgggcgagcagggctgagaacttgctccggggctaccagcctcctggctgagaaagcaagcagggtttccaggtttcatatctccctgcctgcctgcgtctgcgctccagattcacccgctcccctgagttctgtccagaaaactttgcattcagttggaatgttacgaagttcagctaaaggttgctttctccctgtggccttttcccagttcctctggcagccctccccaaggacccctgtaagacaaagtcagaaatggcttccctagggatccagagagcccacagtgctcttcccactggttcctctaccactgtatttagctcggctctctaaattatctcagcttcaggtaaggtcaaatccttctcctgtgatctgaaccttcaggttccccattgaaggtgtgtgttcaggggcagacgatccccctttcccactttcacaccttgggcactcgcagtatttgggctgtctcttgagttccgcaggagcaatctgcttccttcaaagggtctgtggcttctctaggctttcctggtatgttcctgcagcagttcttgaagcaaaagttcttgaccaactaatttttgaactctaatatgagcttggatcttttataaatgatgaggaatcagcactaaacaaacaaaacaataatacctgttatttttatatttatatcccactaaggggagacaaaaaaaagtaaataagtaaattgtatcttagtttataagtgtgagctagaaaagcgtaaaagaaaaagagaacgagtgggtagtggactactattgtacatgtgatgctcatggcagattgcaccaggaagctgacattgaaacagtgctgaaagacgggagccagtgacggggagagatggcaagagacattctgagaaaaagcaggaagaaaatctctctagctattaggttggtccaaaagtatttgcagttcttgccattaaaagtaatgtaattacttccctgcagaagaaagaacaggggaaacccagtgcttagggataggaggggcaggtctgtaccagctccaaagctgtgaccttagagctctgccatgaagagtctgcagctttagccatccagtatgaatgtatcctctgaggacaggtaggctgaggtagaggtatgtcccaccgcagaagctcagaaacaaatggcagagttttaaaaatgaaactgtgtattttgttaataggccaggtactgttagcccagtgtcttcactatcctgttggtatctcataaaacaactgatgatgcagaatgttggtggctccataagactatgtacgtggtggggggattcaggctgcagtggcgggcgtcgtggctgctatgcataatacagcatgagggcaaagagcagctgagcacatctcagctcgagttcctctgcagatgcagacaatgatgagcctacacttgtgggcaatgggcaagggattggcgttgtcactgttcacaagatcacaagagcaccaagaggatgaaggctctgtgctctgcctccagtcagttaaatctgagtagaagaggaggcagattttttttttttaaataaagataagtgtgtggaatgatcaaattatagaagaaatggagtggactgctgaaattacccatttttacatagatgtgcatgaagattaattgcatcactcaaatgattacttcacgggagatttctgaaagtcaagatctcaaaatctggcattaaaccatacatgtaataatggccaaattttagcagggagcagtaaacagtaaaagcattcagatcgcttcgtgaaataatatatggccaacaccaaaatggaaaactagatatagtatgttcaaagtaatcatcccttctttttcttattctaatggccactgtgaggatgatggtcactgaacagattttaagcattagacactggaggaaatgttcaacctggatgatcataggaaggtcactttaattttaattgttttagtgagagtagtaatataatgtttaattgatcttgcttccgaatttctggacaaagatgaagggatagaaaataccaatatcctattccagggaaatttgtgttagatgttatggattagtatatgacagttactttttaataggctttccggagtacataaggcgcaggaaaaataaaatgggtgatgcgacaagcctgggatttacatgttaaacttgctgcaaggtacagtttatctcgtaacaacctcaattctcaattaccccaggggaccagatttcagttggccatcccaagtttggaactaataatagtgaatagtgttacacagcacaatccattgtaaccccaaggaccattacctcattcttaatttgaatctacttgtattgacaagtttaaattaaaaattatccttttagcaacactttttttaaaccaattttgaacttaatatttcttaagtttataattgtttcttcttgattttcttggtagatcatgtcttctctcttctgactctcctgattttattttgtttttcttggatgtaggaaggattagtttgactctgtttctgtcatatttgatattattttatctaacccatctctcttgactcattcaatgctcaacatacttccttcatttctcacactgtcattgtactttttgtcattacgccaacaataaaattcaattcagtagtaagcaagttttacagaatgtgggtggtgattaccctgtagaatatactaaagctctcattattaatatgcataggttctgttttatgtaaaatttcatatattattataggaaagtgcattttggcatgaaaaatgaaaggatttatttattgtgtgtactgatttttcatgtattttattttaatcagtttttataaaagaactttgcagccaggcgtggtggctcatgcctgtaatcccagcacattgggagtctgaggcgggtggatcacctgaggtcaggaattcaagagcagcctggccgacatggtgaaacccatctctactaaaaatacagaaattagctgggcatggtggcgcccgcctgtaatcccagatatttgggaggctgaggcaggggaatcccttgaaactgggaggtggaggttgcagtgaaccgagatcgcgccactatactccagcctgggccacagagcaaaactccatctcaaagaaaataataaattaagtaaataaataaataaaagaactttgcattattaaagtaacagcactacaatttttctagtctatttcttgaaagaaaaaaagcctcaagttataatagtaaagctgacccctacaaataaagattcacaacagattaattttaatattagttatgataaatcatgacaaattatactttctccattgtttgagatagcacagttccactttttacagttagcgatattatgcggcaacacgcacaaagcataatttttttttttttttttgagacggagtctcgctctgtcacccaggctggagtgcggtggcacaatctccgcttactggaagctccacctcctgggttcacgtcattctcctgcctcagcctcccgactagctgggactacaggcgcccgccaccacgtccagctaagtttttgtatttttagtagagacagggttttaccttgttagccaggatggtctggatctcctgacctcgtgatccaccagcctcggcctcccaaagtgctgggattacaggcgtgagccatcgcgcccggcctaaagcaaaatttttatatatgtacatttacagatacacacatatacatatatacacacacataaacacatattttaaagaatacagaaaaacgttactgaatgttctgtatttgtactgaacatcattagaacataaaaatcaatatccctctgacatgcatttttatcaagagctctattagtaaaaatttatcttgaaaattatcagacagtgaaaatagtttctttagtcctaaaaatctttctcataattatttttaaagtattttaattttaaaaatcacatttggttaaaaaccatgatgatctcagaattatacatttataaattaacaaaaaggaaatgtgtgtatgttcattagaaatatgaataatctggttcttcatggtagaactaaacatgtatatctctatatacattgataatatttaatataatagactagaaaaaatgtgaaggcaatttatttcctgttctgtgatataataactcatgaagacatgtatttaggttaaaatagaggcatttttaattcaggcagaaatgaagtaccattttgattatgaaatgctgaacactccaaaaggaaccatctaggaactagaaagcgggtcttcaaccaacaccaaacctgctgtatcttgacattggactttccagatttcagtactgtgagaaataaatttctcttgttgataggcttatcatgttatggtattttgttacagcagtccaaacaaactaagattcaaccttattcaaaagcttgctgatataattgggtaactctttggaaaaatgtttaaatatttttgccccttactgcccatcaaaataaatcatgagtgcaattagtagtattttaatgtaatgcaggagatatgggtccaacagtaattttgaacacatgttgtaccagtcatctgtaaatatgtattgactaatctatattcctttgtttattggacattccatattttttattcagtttaaaatatgcttggaatttttaggtattattaagggtaccagattattattttatttgaaatatatcataggtatggtttttgttatatgaataaaactatctctactaagagagataaaggaaaaagaggcaaaagctcaaaaggaaagagactaaaaagaagagcaaaagagacagcggtgtcaagacatcctgacatcctacttcataggtccagttatttttgcaatagaggtatatttctgtcttttgagtattatgagataccagtgtcaagttaataaattctcctgttctgcctaaatttgtttgaattgagctttttattataaccaaatacgtgctacgtgatataaatcctaacatggcattttaatgccatgaggcgcataagatgcctggacaagtactacatttcctaaagcataataagtgaatacattctccgtatgtgttcatcagtttaaaaactgccatttaaatgcctttgcttaaataggagatttttatataattaaaattatatttaacatttcaaagacttgttttatttcttaaaaaattacctcaaatagaaaattcatgcttaggatatgaattataaatgatatcatgcaccttgtacttcagattacagacagatatttaaggcaagaatacttttcttgtaacaattttcttgtttgctaggagcaaatggacaacacttcaagtgtaaaactaaatctattaatatacacagtgatttccaaatgaactcagatgatttttagtatctttaattagacagaaaacaaatagaagtcaataattataatttcacttcttaaaacttctttttcaacaactacacgctacacaaagttatcagtatttactagtaagtattgagtattaaaaatctgactatgtgttgaaaatactatattaaaatcagtaaccactgttgaagtgttttggctggggaaaattttagctaaatttctcatgtttaagtgtttaaggtaacacaatataattttgtccttgcattcaagtgttgataattagacactataaacattgggaagcatttcctaaaaataatgggctaatctataatgtttactgtgaggtttttggacaaacaaatacaataaatagaattattgccttgtataagcaaagaagtagcagatagtctataaaaatttgatgtttaaaaatgaagtattaataattgacaataacattttttattaaatcaattacaactgataaattttgaaagattacattttgtcattatcaatcagcagaacattaaaaaaaaacttgttattgcgtgtaagctgttttatttcacttgtactatataaaggagtaaattgtaaaaaaaaaaaaaaagttaaccaaaactgtgatattttcagtgtaatactctttaaaaatttagaatagtaatatgtacttcttagtgaactttggatccttcaccatgaactgcagaggttaagtcatgattcctgacaagcaggttccaatcatctttcaactggaggagtaccaattgtgtgtttacatagtgtgactccccatattatttcagtaggattctccttcctgaccaccacaactcacctacacacatagttgaaaaacacactgttttaggcttgaggttagataatttgagtaacaaaagatggcatgtgctctgaaaccagattgtcttatttaaacttaagctcaaccaattagctacttcttagtaatatgtttcttagaatattagccatcttgtaactgaagccaggtttggccactcagtgcttgaaatccaaacatgagagagaagggttggtgggagaaaaagcaggtttattctgagagccaagcaaatggagatgatggtggactatagttgcaaaaagtttaagtttaaaattttaccatagagtttttaaagggaaacttggtatggaaaacatgaaggagtagtgcagagtccaagatctgtgtctctttgttccaatggctatcttgggtaatcagccgtccacaggtttggttggtgttttcttgaattctcaggatagttctgaactagctgtttgcaactctctcaaacaaatgggcaaagattggccaatcagagctccatgcctactttgttcaagattagcctttggaatgtcttaagcaaaaccataattggataggcatacattgccagaggggagtgtctagagagggaaggaatgaaagagtgagagggaaaaaggaagggggagaaaagagaacgtgtgattaaagtatatttttaaaaccaaggtctatagttacaatcaaataatgtgaatacttattctgcaaccaagtgactcttctatttatttatccataataagtaggtatgtcttttgaaggaccttataattaaataatgattgtttcattaaataaatgttttttatattacaaatatagaagtgaggttgataattctaaggtcatttctgataattgtatacatttaagtattttttttatcatctaagtcttcatcttgtgtatcctttaaaagtttatatttttcatgatataatatgggaatcccttgaattatgacatttcaattagaaaacaagttttgtcaaatttatatgtgttaaatttgcttcttttcatatctactaatttaaaaagcccaatgtttatattagatatttcaggaagtggcatacctacagatatttgtcaattaccatgatatttatttcttgttattaatgtaccctcctctgaaatatttatggaattctgtgcatgtttttggccttctttcctgtatttattctttctctattgcctggaaatgattgttctcatccatttctttttatatttgtacttaccaatcatcgattaagattcaaatcaaatgtaaactcctgtaagtattttcctgactttcattccttttcccttgttatccccttatttaggcatgctcttcatggcttcattattaccataattggttaatcatgttgtattgtattaactacctatgttcctctatttctcaagagacggcaagttctttgagggcagaagctgtgttatttatcatttttcctggaatcacaatgattattccatagtaggtccttaacaaatatttgtagaatgaatgagtgaacaaaggaatacaagaatagtagaaagtctacgcgattaactgctttgcacctggccagtgtgaatgatgctttcatgagctaaccttttacatttggttcataatttgtaaacacagtgtaggggaaatatacaggctgactgaaaatagttatagaaattgagacaaaatacaaagcatgttaagggagcaatgaaaagttaagggaaatggcaagatgttttaaaaagaaaatgtggcaggagtatatacaggttaaaattatgagggctgatacctattttgcatgagcctacttcctttctttttcagatctgctgctggtaggctttcaaattaaaaagtggtactatcacaaatgttacaaaaatgttaccttgagtgcagcaagttttgtgcatgctatagacatgtatgctaagacacaatgaagataaacctacaagttaatggaaaaatcaattaaatttgatttttataaaagagttttagaagtgattaataattactgttaaatgaagaattaattcaatttttatcagttcctttaaaaattttccaggatttagcttgtgaattacttgttctttaaaaagaaaattgtaggtcacgatcagaaagtgtaatacatagacatatttatatatccacatgtaagatgtatttatatttatattttatacacacaaataactctaaacagataattattttaaaccattttataaaacgctgactttatgatttttttattattcagtgtcaaaatataaaatttgccctctttaccttgataacttgttacatctgtcatctttctttagggtttatacgtgttccctttattaatcacttctcatttctatttaatgaccaaattcagttgtcaaagtaattaaatctaccttaggaacaacttaccatttctatgtggttctcaagtcttttgctaaagtagcagaaaacttccttctaaaatggtgtaaaagtgaaaaaagatatcatattgaatagaaaaatcaaggagaataataccctaaaggtaaggatcttaaatgccaagtgccctttctcagcctcaaccatttattctgaaaatggcctatcaaaaaagcttagaaggagcagtttaattactgttcctttgacataagtaataaattttcagtagcagaaccatgcatttatttaaggccaaatggtgtacaacaaaactgtcctccaaggtatttctttctaccatttttccccacttggcctctacagctacgttttaacaacaatgtcttttttgggagatattttaaaatataagccttaaatcatggttctctttagaaataataaaacccagcaagagaattaagagaagagcacaacttacttttaaacactgaataaattaaatgttttagtatatctatatattatgcttatagatatatatttatactttatgagtactttctacactgaatctatgccaatatgggtacttacctccactagcttatacctctgtatctttacgtatgtccagacttcatttatgtcatgaatgaagaaatcactaatcgactgccattagtggatggcacaagggcaaagtccattttgttcatagtggttggtaccatccctgaaacataatagggatctcataataatatttaaataaatagacatttttaaattctgtatcctgataagaatcaaaacacatttcttttttaattgtcaactttggttttaaataaatattaggtacagaaatctctctcttcatatatatatacatatatatgtatatatatccatatttcctgaatttattagtccttatcccactataagaagcaagtcatataatggttttgaagaattaaaatccctttaagagttgtcaatgcattattaatgttaatataattaatgtataatattaatatattgttttgaagtttattctacaaatatatatatatgtatatgatacacacacacaaatatgtatatgatacacacacacaaatatataccccttttgacaaacgaaataaagtttgcaaactttcccatcttttgtgcaaatgctttggtgaatctggcctaagtagctttatctttaaaattaacttttattcttaatatgttcttctatcatatacagctataagcaaaatattttaatgacctcattctgggtaaaatatgtcacttaaaagtattaactatcaatcttttacatccagtttataagggttgtgtaaatagtaaaattgcagggtcaactgaaactgagaactcaaactcaaactgaagactccaataattaagaatggctcagagaatattatgttcaaataaacaaacaaaaatacccccctttttattaatctacataatccctctttggtttaataggatttaaactagctctaaatatatgagcctctctgaattttgagaggcttaaagctttcttccaggcaaggaaagtggattaaaaccaacctttgtgttttacaatttgcatttaactgacctatactgtgagtctaactaaagcccttaagtgttttcttctcctggagctggcatctctctcggataagatcatgagattctatttcctttgatgtatttcagcttgcaagcacagtaacatgaacaaattccttgccagctatcctcttctctcccaacccacacatgcccccaaagcattctcggctttcatacagagctctttatttttgtggcaaatgttctcatttaagggggaaaatagattttctgagaaaatcctgaagggggaacacatagatcttcttaatgaggtgtcaacgggatgtcaatgaggtgttaaaataggtcgaggccatgctgaatttttcctttctttttcaataatttctctaaatttccagtagccaatgttaataaaatgaaaaaccaccttttctttcatatggtctgctttgatgaatctcattggcattctcaaggttgctaacctatggctcttttgaaacagaaccaagatttctatgtatagttcttcgatttttaaaaacaaaacacaatatcatgcattaattatattatgcaactgctataatttttatcacttatgtaaaaatctcaaatatatatgtgcatataaatataaaaacaaaggaatgtatagcgtatactttcatgtctgttttggaagcctataaccttatgtgaactaagttgcatagttaaatgtggatgacaaagaggcagccaaatttaaatatctttcaaagaaaaaggaggaaaaaaagaaaggaaagaaggcaagcaggcactctgaatgtattattcattaatgaagagagtgctgtatggcacacttgtaaggcactgtttgtctgagcaaagtgggcagttgatatttacaagtatgaaatataaagatatcaaatatattaactggagtgctgctttatggattggctgactttcagaagcatgagaatgactctcaaaagcctggctactggtgccaaattgtcatggatcatttacaaccattttaaataattacaattattttaaataattctggtatgtgttacttactacagctgaagaaaaatcagtcctttcctagtaggtcagaaactttttattcttagtcaactctgtttgtctgtcccagccaaagctccaggaaatatcatcaggtattgtctagagccctgttgttgaggtgttgattcgaccagaagacaaacatgtcatttgtgaaattctgattttcagtttgtgtattgattagcataattttttctgcttttttctttgaatcatatacagagccatatggcgacgatagctgtacaaaaggccttgtgtaacatatcaaatggatataagtcaagtaacaataattgaaagtattaaaagattgttcagtcttgctgaagaaatcaagtgacaatgactccctaagtctatattttctttcatctgcataggtttttttttttttttaatgagataagctttagacaagttaccttcccattagtacagatctagattttccatcttaatagtggtattcattcgggtacttaagttcagcaataatgcagacttcctgctgcttggccaaaaaataaaaaagaagaaaaaaaaacagaagttattatttcatccataactaattgaactaagaaattaaactcatgagtggttcctcaggacataagctatactatttattatattaggtatttattatgttaggtcaagtaaggaaaacattttttattaccaccttgtgtcattcactgctatggataagatggccatccttaggagtctgttgtaaaaattgttagttatactaccagaaaaggatattatgcgtcccatctctgcaagaagacagttctctgagaaagttaggaagtcatagacttgtaatggtatagctttttatgccacagaaaagtaatccttgctcctggattggcattaaaaatgaagtgattctcacatttaaaaaaaagaaagaaagaaatgtacaagagatgttactatttttattagagttctagatatattatctctgggagttttcacgaaaaatagtcactattacaacctaagaatatttatttatcctattccattgcaaatgtaagtttctttgtgttcaaaagggtaccattataggtaagattgcctgatacaccttgatattctcatttttttctatgcttaaacattttgaatgaatgcaactttccattatgggttcattcatttgtcttttctctgacaagacacagaattacataaattgcacacactaccaatagtttgagaaatcaaaattaaagacttggggtatcatggattaaatggagagccttaaacaaggacagaggaaaaatatagctaaaaaggtaaaatgcaaatgtatacagagaagatatgacgattgtggttcaaagactctcttgttctaactgatactgagaaaaaactctctaccctatgtgtactccaaggatctgagtctgtagtttacctctctaactggagaaactcactttaatcttctatgggtgtaattttgtagttcttttactttgataatgggtgaagttgttttagttgagtaacacatatccaagtatgaattccttgtactttaattgtttacaaagtaatcaaggacatctgatagagtatatttctccagcaatgtccaaaatcagtatttgtctgatgtcttctccagaataccagataacctgatataggttatacaggggacgatttggtggttgaaaggaaggacaccatgataggactgatgtgaattagtgctttaaaatattttgctaaccaacttgcaaaagactgaaaacaagtacagaggggtttatttttatttgcacgggacagtcagtgaacttgacagggggtgacctatgacttcttgagaagaaagaatgaaaggctatgaaagtgaattatagtatgctgggtcatcagagattaaggacgtatgacagtttagataaatttggcttttacattccatttgttcttttcacttttcccaagatttgtagatggtttggacactgagtatctgagtaagagacacaactttacatcataactatcatagtaaaatgtatttctctatcaatagagaaataagttgaaatgtactagttagggaaaaatgtaatatgacagttttagccactgtgagtacagtagcttgttaacaggagaataattttaactagaaaataaacatgttgttagtgaattattgtacccacagagggaggctattatttggtgatgtttaagaagtccctctgggtgtagttccagtttatttttaatctttacagtatttccaggattgtgttcattatagatgaagttggaattggcatgtctactgcccttcttgaaaatgtttctttctggttttgtttgatacttttaccatttcctcaccactgaattctcatagaaaatttttggcaaaaagtgtagagattttcttgttttcctaggcaagtgtcctggcttctcaagacctattcttaggtatcatagaaattattatttctgaaatttctttccagaaccattgggcaaactgttcatcaataatgctattattaagcctctctacagataacatctttccgatatcagaaagatttttccttacgaacattttatcacagtggactccttattatttaaagtcatcatttgtaaaatgttgtcatttaccaaggaaagcaccagcattaagattataatgaaattatacttatgaagcagaattttgtcaggaagacatggcagcttgatgtgaatgatcacatgacaaataggataaaggccagtataattggtcaaaagtgtataattgtgaaccgtgtcttgatttccattacaaaatagtctctgaagtggccatatgatcaatgagctatatgaccctaaaacacaagctttacagggtaatattccttagtaatttgacagaacaaaggtgacctcaatgtttgttgaggtacccaaggcacagtatgattaattgacttttcacaaaatggttattactctaaattttctacaaccatcaatcttgggggttacattcaactggagattgattggccttccttttctatgtgttccatttgaagcttatctttatgcaattaaatggcttcaaattatcaagataacataaaaacatctgagataataatatctacaattagataaatagaaaacaagggaaataaaacacacttggcatgagaatgtatcaaatggtccacctcaaaaacaaaacattcagttaactcatcgaaaataaattagcacagaaaattgttgagacagattcacctagcagcagataaagaagatggttgtagtttgagcacaagggtttaagttagtgtgcctgtttctctgagtatcctatggaatgacagtaataaaaagaaaaaatctaggctgagtgcagtggtgcacacctgtcatcccagccgagacgggcggatcacaaggtcagcagatcgagaccagcctggccaacatggtgaaaccccagctctactaaaaaatacaaaaattagctgagtgtggtggtgagcacctgtaatcccagctactcaggaggctgaggcaggaaaattgcttgaacctaaaaggaggaggttgcagtgagctgagattgtgccactgctctccagcctgggcaacagagcaagattctgtctcggaaaaaaaaaaaaaaatctatattactgaaagctaaattcgttgaagaataatatcacaactcaatatttgagacaaaaagctgaattttttttattgctatgcaaaggaaagaagaccttgtaaggcacactgcctgagcaaagcatagagaagatctcaaataaagatttgagaaatgtgttccttatctatgcttcctcacccaacagctcacaggataatgacctcagaaatctatttgtcatcctgcatataccccttttcctcacctctcactctcagagaatgactttcataaatacttcactgaaaaaatagaaacaatccaacaggaattttcctatttttctaccataataaatacaacatgcactcatctgctcaatatttcctgtttctttttctgttccaattattatgtttaaaagtcataacttgacttttgacaaatgttataaagttactttttcataggatcttttctttcttttctatttatttatttatttgagacagtcttgctctgtcacccaggctggagtgtagtggtgttatattggcccactgcaacctctacctcccgggatcaagagattctctcgcctcagcctcttgagcagctgtgattacagctacccgccaacatgactggctaatttttgtatttttagtagagacagagtttctccatgttggccaggctggtcttgaactcctgaccacaggtgatctgcccgctttggcctcccagcatgctcaaattacaggcatgagccatcatacctgatgggtcttatcttttctaagttgctgaaggtttgtactgctgtaggtgccatctctcccattcttaatcatcagattgtttctccggatgctcttccatcaacagatgaacatgttctggcagtttgcacatgtgtacagaactactcattaccactccaagtctatgatttcatttgtaggaaaaaatttaaaagattttgtatttgttatatttgtttttttctccctataatgattgggacccattccagattttgtctattgattttatccctgtatgttgtcatatataagttatcttttcaagtttaccagtgaactccatgttgcataacacaatagatatgtgcaatcttattatatttcttcaagtgtttgaaactgatgaacacccaatgaaataagcattttatttttcattttctatattctaccaccaacctaataaaagcctgcaataattagtcttatctgctaatgtttccggtgcttaccacagaatgtggcttaaaatagttgtttaacaaataatactttgtgattaagtgaggttaaaaaagacaacaatatccacttaaagccattaaagtagcagcatttattgagatagctcgttgttcacattattggtatagaaacacagtagctttcctatatgcagaagttaattcttaaaataaaaattggacaacttgtccatttatagcattaaaaagattaataataatattaacaaatatatacattgaatatactatagaaatgacactttaaactctacagagatgtaaatgaagtaaaaaaaaatggaaggtaccaacatgctgttacctatacaaagacataatcttcaaatatatttattttatttcaattaaattgcatatttaaagctatcccaatataaatcctgacaatattatttttagaactagaaataaaccaccaaagtttcaccacacagagacattaaacaggtaagaaattacagcaaaagcaaaatagctatgtctaactaagttatcttaatacgttctaaagataaagtgatgtaaatcatcaccattttgtttaggaaggatgggtcagtaaagtacagaaagaagtctttaaatagactaaaatacatggatgaatttattgcataatgttgttcagatttcatgttatgaaagaaaatgaaattatttaataaataaaggacagccaaatcttattgcgatttgcaaagatataacaaatcacaaccttaattaaaacatcaaagtattttctaagtgactcaaaggtatgaattttaatgttatactacaatgatactctaaaaaaccatgatactaaaaataatacaagattctacaaacattccttaaagtgttacttttcaagatgtttgttccaagacagtccttcaagtcatgcaataaacattgaaagaatcatgataatgctataaaatactttttgaaatattaataatacattcatacccataaaactattagaaataatttttttaaaaaaattagaacatgtagaggaaaaaatagtttaaaaactcccatgaggagacagccttcagaaataaaagtacatatgatcaattatgttaattttcttcatattgaaataaatgtaagtgttaaaaagcaatattattttaaaataaaggcaaccagaaaagaaatagaaacacaaatttattcgcccatggaactagaggacatagttctaataggaatgaatgtcaaaaagatatgtcggatcatctgaatagaatacactgtggctgtaaatatcggaaagcctgaaaaaatccagctttctttcataagcagcatagccagaggtgtaaggctaattgtgtgtttcgtcttatttttgtctttgcaacaggagagtagtccacagctttaaaaggtcccaatactccattgtttccaaagagaaagagaaattaagatggttttaagggtcaggcgtgaaagatataatttcaggaaaaggtctgtatgtgatgtttaaagcgaagaaataatttgcattgtaaacaaaacaaaagctgccaatctaagtttattagattcacgtaaaggcttagtaaagaccgtgttcgcatacaatgttttctcttgggaagtgcatgtatttgcttggattaacctctccaaaacattacacagttgctacttactgttccggtaaaaactcaaaccagtcaactatgtataattattattattaataataataatggcagttttgtttcagctcgggaatttagatgactggaaagagcatcatttgctcccttataataaaattgctggacaaattacatataaatgacattttctgaaacattcagagaatgaagaatatagagcaatcatcttcaaaaacagagagcgacatgcctgagcagagagaaacaggagcaaacatttgcttaccttggacagacactactgaacaccatctactgcaatgaaagattcagctagaaatgtttaacagatttgtaaaggtggagatttggctgacataaaagggtaaaacttctgagatccataagacagactatatcctctcacagacttttcctccaggaactgtagaagttgctcacagggaaggttggaaaacatcttgagaaaggttccttcaagtgctgctggaggagaattgtcaccacgatcaaaactctacaccaatgcaacattcctaaggaacaaaagactttatacgtgaagattatcaaaacctggagcctgaggaacatggtggaaaatcactgaagctggagaaaagaaatgtcgaccaccaccaacaatgccacgcagagccatcttctctatctcatctaagcaacaaaaggccttaacctacctggggaaaggagtcaaaacaatagcatagagagaggaacagtaaataaacaaacacataaaaatagacatatatttctacatgtggggagaggttaggctgagcgttacatatggagaaggggcaggaagactcctgaaggctgcagcactgagaccctggtacaccggaatctaagatgagactgaatcggcacatccaactacatcctgctcacccaacctcatcaccacattaccaagtccggtaaaaatgacagctgaatgtttatttgctgagagatctaccatataactctgggggagcaaaggaagacccaagaacaagtagggagagaaacacaagttattattaaaagaatttgaaaaacgtgatgccaaaagggtagaccaaaagcaatagaactcaaaacgagcgcgctttctattttaacacaagactacacactaaatgcccagcagaaggcaattagaagaaatcagtaatctattgtctaagcctgcttgaactggattttcagttatttacttctgaatgtgtgcttactgatatcctgaatctataccaactttagtattaagatcaagatcttgcccaccaacacgcaggtaactggatcctgctgttgcttcatttcaaagttctgctactctgtgctaagttagattcatgtgttcacaaaaaatctcttcaaattattttccagagttgtttcattgtctaatgagataaaatataaatacatttgtctttcccaaatctagtttcagctgtacatgtatattagagattgtcatgtaactaaaatacttccataatttctaacactaaattagttttttccttttttataggttttcatcattttaataagtacttggaagataagaaggactaaaatgagtcccttagtcatagttaagaaacagaaattggaacagggtgcacttgcttgtgcctgtaattccagctactcaggaggctgagatgggaggatggcttgagcacaggagtttgaggcttcagtgagctatgatcctgccagaagtccagaatagcattctgctaaaaatttacagtgctcgttaaaaaaatttgttgcttatttcttctctctgcatggttaagtgatattttcagacacaaactttagagcaggctttcaggtaagttacaaactgtagctatcctcagtcagtgatcttttattcatgctttttttacgcttgattatgcttcagtttccttttttatatttggtatagttactcagtctagttatcgtagacttttaatgattctcatttcaagtgtttccattgagtcttaaaaattatgcaatagtattttctcccctattcttgatcttctcttccagtggtgttagaagagttcactcaaggtcttctcttgtaacgtgaaaagatgaatttcatcccaaactctgctgatttctgccatcttagctgggctaatacttgggtttctggaattaacttctgtagctataaaacattaagtaaggtttcagatctcattctctttcctgcctttgatatcaactctcacctacaagattgaattcttttctctttactttagaaaatatacctatttctgaaggtagttttttcctacagtttaatcccatctatacgatattttgatggctttcttgagagtttattcatatggataaaatgtaactttctagtttttctgatatgctgtttttcctagttttaatattttattgatcaaaggagacccagaaaattgagcaatgctcatttattattattcattcaaattatcaattcctttgtatttgaagaaaactactgtatagtaattatttgtctcttttcctttattatgtacacacaaagcgttgctaatatttgttaattcacatattagctgcaaaggatttcttaatgggtatttctggctaagttgagagagattctaggattactaaaattgtatgaaaattattacctggtaggagtgtgtgagaaaaggcttattccattcaacatagataatagtcatataaaattaaatgtataaattttgatttttagtgttaagtattcggttttcatttttaaattgacaattttgacaattataggcactcactcaatacaagctaaaaaatatttctgtcaccctcgaaagttcccttgcattccttttcagtcgatacttctctcaccccaatggaaactgctttcttatttctatcactatagattagcttcatatttttataaaatgtttataatttgaatcatacaaaagagacatttgatatcttttttaacataatatttctaagattcatcaatgtcatcacgtgggtaaatgaattatttctgtacaatcaatgtaaatcccatgaaatagtatatgggaacactgcactcttcctttgagtctcatttttaaggatttacaacattatgttcacgcattctccagttaatggacattgggttttttcatgactgattattttcaataaagctaccattaatatttttcacatgcttgttggcatatattttcatttttcttgagtaaactcacagataggtcatggagtcataggacagattttttaagtttttaagaaattacaaaagagttcctcaatttggtcgtacggttttgttttctgatcagcaatctattttcagttgctccatgtccttagctacatttggtattttctgtgttttgatgctatccattataatggatgaataataagatctcattattttaatttgctcttcctgatgactgataacattatgtatttcattggtaaagcatttattaagatttccatatttcaggtcatttcaatttatttcaacaagtgcatggacactcttgacattttgtgccaaataattattttggttggtgggggggatttcctaggcattgtggaatgtttagagaattcctcttctctactcagtagatgccggtatcacttctccccagttgtgaaccaaaaatgtctgcagacattgctaaatgtcctatgggggaaaaagtcacctttgattgagaagcaaggccattattttcttgagttttgcaaaatttaataataatttagttgtcacaaattacattatttctggaatgtctagcataggtatgaatattagtcagcaataaaaagaacttgtgacagaactccaactaggataacaactttagactatatagactcagcgataatgtagatcttaaaatataagatattctatgtgttggcaatatccttagtgctccgttgtgagtaaagtgcttcctacagctttacttttcaataggcccaccaacaataacacaaatttactaaaaactcatactatagcaaaagtccttgtgattactataatagtgtgcactaagcaaactgtgatatattaaagatgtccacatattcttttgttaaaaaaataggagttaaccaatatgtactcatcttagtcagtttggcctgctataacaaattaccacagactgggggcttaaagacccaacatttatttctcactgtcctggtggctgaaagtctgaggctacattgccagtatggtcaggttctagtgggggcctgcttcctggtttgcaaatggccagcttcaccatgtaacctcacatggcagaaacagagtgagctagctctctgtggtccctttagtgagggcactaattccattcatgagggcgaagcctaattacttcctaagacaccacctcctaataccttccgattgaaagttaagatttcaacatatgaatctggggatggacactaacattcggtccataaaagttcctgaagattttctatgctaataaaatatattagtcatatatgtatagaaaatatgccactaatttacagttaatacttaagtaattattattttacatattaactttgaaaatttgaaacataatagaataaatcataaaattcagtttctaatgataggcagggttatttaaaatcaactaaccttttgatattaatatcttaaattcctgaattaattcctaaaaagttatatttaaggatagtggctaataggaacatacattaagtaaatttttcaggcaaattttatttcagtgataataatatttttaaactctcttgtaaaatatattataaattaatacaaattttctctcaaatatacatatatgcatattagatgtatattcttttccgtcctgatggccacaccatagtaaaagcttacatcattatatcactaagctatcagtagcaaatatatttttggttcacaggaaccctaaatttgacatctaaatgttgatactgatataaaaatttaataataaaattagaggttataaatcatgtaatctctggcatatcaaatattaaatacatccattctctatagttttgacaaacattggtttttcactctggttcattcaatttcgggaagctgtccatcatataatttaattaccagtcagttcttattgtcaaacaaatcagccaaatttatattctggcacaaaaagcccaactttattaactgatctaaataagtatgcccataaatacagtctcattctaaattataatccaaagatgagaaagataaatagatagataaaacaatcatcttcagtattcctcaaagaaactagctttgctctgctactgtgaggtgtgctttcttgacatttattactttcaatcaccagtggtattttatcccgtgtcagtgctccatattaatatttgtgaatggtaactgacatgtatctattttataaagtggggcaaaggctttaaaaaaatgaaagatgaaaagaagaaggaacacatcacagactctattttcagagaaatcattattaagagagtgtaaaccaggcagttcaggatctggagaattatgttcttaagaccttatattccctcttactaactgtaagcatatctggtttttagaatactatactagatcactgcgatcgtgctgatgactgtgatggtaactgtatatatcaacttgggtgggccacagtgccgagatatgtgctcaaacattattctggatgtttctctgaggacattttttgatgagattaacatttaaatctgtggcccttaagtaaggcacattaccctctattttgtgagtgggcctcatccaataagctgaaggtctgattataacaaaaaactgactttccatttgcaagagggaattcctcctaccttactgccgtcaaacctgaatttaaaaattggttatcctagttgatttagcctcagaaacaccctgcaaattttggactttccagcctccataatcttgtgagacaattccttaatatacgtatacatatacacacatatatatgtgtgtgtgtgtgtatgtgtatctatgtatgtatatatgtatatacacgcacacacaaacacatcttatttgttctgtttccctggagaaccctgatgtataaggaccatggccttttcttttccctttaaaataaattttctacaagaactggagttcacaatttcaactgtaaagctaaaatttatcacttcccagtttaaattgtattaatgaataataatcatttatgctaatttttaacagattcttccttaattacaacatcttatagttttcttacactattcattgtctgaattatcactcttttgcaatgcaacatatggtgtactatcatttatctttgataatctgcatggacactatttgttgggagcaaacccccccaaatccaaccataaactggccccaagactgaccataaacaaaatctctgcagcactgtaacatgcctataatgtccctaatgcccaagctggaaggttatgggtttatgggaatgagggcaaggaacacctggcccgcccagggtggaaagctgtttaaaggcattcttaagccacaaacaaaagcatgagagatctgtgtcttaagggcgtgttcctgctgcaattaattcagctcatcccttcgtttcccataagggatacttttagttaatttaacatctatagaaacaatgctaatgactggtttgctgttaataaatatgtgggtaaatctctgttcggggatctcagctctgaaggctgagacccctgatttcccacttcacacctctatatttctgtgtgtgtgtctttaattcctctagcaccactggattagggtctccccagctgagttggtctcggcactattagattgtaaattgcttgcaatcactatgaaaatatttatttactttagtggacgaagcaaaattttaaactaaaattctcttgtccccaatttcatagaagttactaaaaaatattttctgcaagctccacccatttttcttctatatattatggactgaagtataacactctcatgcaactatatatttcatttttttagtataaaaaggggaaatttatattatttcagatagtgttttatgtatattaaaataaatataaaattctgtattatcacctactccatttattgaaaaatgatttaaagcatttgaggtactcaattgttgttacatcaagtgttctctatatgttaattagatgctgttggtttatttggtttgttcacgtattggttggttatttggttggttcacatagtctatatcctgtcattgttctttctagtagttttatcaactgctacaaaggaggtattgaattctcctactctaattgagctccatcatttttgcttcatgcattttgaggctttgttttttggcgcataaaaacttagaatttttaattctagtcttcctggtggaacggattctttttcattatgcaatatccctgtttgtttttagtaaaatttttgctctgaagtctatttatctgaaattaataataatttagccactcctagggttttttgtattaatgtttctataataaatatatttttccatctttttactttcaccctacctatgtcaccaaatttaaagtgattttcttctaaaaagtatatgatgagtctacatgtttaaaatccattccaccaatctatgccttttggttagtacatttagataatttacatttctatttactggtattattgatatgttagaactgaagtctgatcatttatttatttattttttgttttctctagctcttgttcctctatttttttcttttattgcctcctgtgagtactttgaacacttttggaattccatcttgacttatttctactgggcttgagtgaatattattgtgtgttttaatttgtgattgttctgagtatgacgatatacatgtatgacaatatagtttgctagtatcaacttttttgtcttaaagggaagtgtgaaaactttgatttcatataatatgtccttttgattttccagcttttaaatattattgtcttgactaaaagatagtgtaataatttttgtttcaatcttcaaatctaatttataaaacccttaagaaaaaggtaattcattgtatatactgatatttctgcttttttccatttttcttttttcaacctgacactccaggtttccctatttttataatttcctttcagtttgagctactttctttaacctgtctgtagtacaggtcttttggctgtaaattattttggctttcctttgaagcatgtatctactttctcttcattcctgaaggacagtttcaccagatataaatttatagttgataattcttttttcagcacttgaaaaatgcgtcacttccttctggtctccataaattcagatgagaagtcttctatcacttgaattggtgtttacctataattagtgcattgtttctctctagcagctttgaagattttcctcaagtctttagtttttaaaaatttagttatgatatgtcttggtgtgaatttccttaggtttatcctcttttgtgttgacccaacttcccaccaaatttgagaaatttttggccattttgctatgaagagtcatttagctccatgtttattcacctacctttctaaaacctgatgaaaaaaatgtaaatctttagttactgtcccacagttacctgaggcactatttcctcctcctcctccttcttcttccaacattttttttctttgttcagatttggtaaattctctttatttgttctcaaggccaccagttctctcctctacatctccattctattattaagcctatcccacaagtttttagtttggttattttatttttcatttctatatttccatgtggttcttttttgataatttctatggcttgactaagattttctattttttatttgttttaggaggatttttaattactgttgaaacagttttatgatagctgctgcttttcagtgttgtcatcaattttcatattttcttacataagttgggatttactttgttcttgcagggatagctaatttcacttgtatatagtatattttggctattaatttggaaaatattaggttctacaaaagtactttattttagcagacagtcatcttgttttgctttagcatgcagatcctgaactattgagaagaggggggcctgtggttctaatgacaaattaatttttgagcctttgccgtgttatttttctctgtgtggtttacctgatactactggggtttccaccggtcctcactaattgctgccttaggtagtcaaaggtgatttgccaggtgaggtagactaggtgtgggaagcaagtctctgggccacaagaataaaaagttccccagtctaggtggcttgtggcaggattcttcttgctgccagtttaagcagtatctgtgagtgaagaagggagttccatgactggtggagaagagcatttctcaggccgggcactttttggagctggatacccactttttgtggacgagggactgctgcttacgctggggtttcttgtggaatctctttgccattgccactttgctgcccaagtgtgtctctgcagctgaggagaggctcaggcccataaggatgacgggcttcctgggccacagcactttctctgacaacatccacttgcaggtggccctcagctacctggcatttctcagtggggagggggattctcagtaccaagggaactaacaggcttttcagaccaggtgctttttgtggcaaggtcccccttgcagatattcacagtcactcagcatctctggctggaaaagaaggtctcaggctatgagtggaaagactttcaacctgataatcgggccacatattgctagcagtcccagattgtactcctttgcccagctgctgtgggtgagactcctattcaatccagggtagaaataaggctttctggactgccttctgttgctactttgggagtcaagaaacgtgagatatgggttgctttctcttcatggttgaaagatcttaagatgtcctgccactctcttcttttcccaattctgaagttcctacacagtgaacttcctgcctcctcctttcaccattctcccgtggtcacgtcttgaattatttcctgtgtttggaattgtacttagtgggaagaagcagggagaaaagggtctacaacatcttgttctgaccagaatttagattagatacaaaggaacaatggtttgtcttagaaattctaaattctttcttttattagtattttgtttttttgatatggaatctcacacttgtcacccaggctgacatgcagtggcacaatcttggctcactgcaacctctacctcccaggtgcaagcaattctcctggttcagtctcccaagtagctaggattacaggcacccaccgccatacccaactcattttttatgtgtatttttagtagagatggggtttcaccatattggtcaggctggtctcgaactcctgacctcaggtgatccacccacctcggtctcccaaaatgctgggattacaggcatgagccaccgtgcctggccaggaattctaaaatcttattattttaaaaggtttaaacattaattttctttgtttccaactggaacttaaagcttaattttgttttattacaaccgcttgttattacagatgctgttagagttcttaaagttagtttacctaaactatgtttccttttaaaactaattgctatgctttagagaaaaatatatggcagggcctgagctaaactgaatatttctttcccttctttttttcctactaacaaaagaaatgcattagcacattactctggttcagaagaaatatgaactcagggtaactctaatttggtctctagctaactagaagaataaaatatcttttttatacctttgaagatgagtagcttcaattaattgctatatagggatagatcattaaaatggttctttaaatttttttccctaaattctattaataagtagaatatatgcaatgcaaacaaaaacatttcatatgatgttttctgaaaacctgaactaatttatatcaattttggtagcatgcttttaattataatttagttacatatttgttcttattgtaagaaagataacagaaatctactgtgcagtgagactttttcctctttacttgaaatgtttttacttcttattcttctgattccataattaaaagtaaaaaaaaaaatttgtccttttttctatattttttaacataaacatttttgcaagttacacccatagttttcccctcaataattatagctaaacacttaaccaacttcttgtttaaacctaaaaaagaatttttggtttccatttaagtttgcacttaaaaaaccttaaattttttaaggaaattggatgtgatctgattctgtgtttgtagatattcattgagttttttattggtggcataatttattattttagcttctagagcggccctagaaatagtgtggatgacctggagaaaagagactttaaatatgttgggcatattttatgacactactgcatataaaagcaggtggtttgctaatatatctatgaatatgccatgcctgtttagtttatataaactaatataatagtgcaataaggaaaaaaaatagtgaaactagaataccttaatcaaaatttgcctatattattttgaatatatttcctcatgattttgacccagcttggccttagacacacatagactgatgttaaactgacaaaatactaattttacaagattgatttaactagaagaatgtaagtcgcaatgttaattcaaatacaatattatcacaattgttgagttctctaaaatgttgatttacctcagcaattttaaaaaggcatgctcactggtaaatgttcagattaagaaatatattccatggattttttgaaatacaaattgctcaattgaggttaccctttacctgatggtattaggataaatatttatactttagatttgaatttagaatttgatgaaagtattgactaattacgaaagggaagaataataccttattatcaagatgttatttttaacggggaaaatctggcagcagcctcaccttacaaacaactttatctagtagtttacaagggacccacagtatactgtcatacaacttacagtcctgaaagaataaacactaaggggcttgctataaaaaataaatttatgaagcataattacattcttttggtaaggttatgagttgagtattacataaaggcaatcatgtttatgaagaaggtaaataattttaataccatagctgcactctctatcttattaaggagaaaaagttagcctggatagaataaaacaataagtcaagaggaattttttataaggtatgttaaaagaaaaactttagacaaatttcacagagtttttttgagaaaaagaacaattaatgaatcaggcagcactcggaaccaaaagacgttcagatggctctgcccagcatgtaagcagtgagccttggaagcaaagtagagaaaccgccttattggctacagggaggcatccatcgtaattgtgtatggtgtgattagttggctgtctgtgattggctgaagcatgactgttgttgattgactgaaaactggatattttgggaaaaaaacccaccaacatgtattcctaaattaggttttggtttgttaatgtgctaagtcaaattgttgttagttaattagtaaccctaagtaaggagacagcctcaggctaatgacgtcttgcttatttaatttaacagctactgtgtgccagagaggtaatctcacttaaacctcctataaaccttgccaaataagtcaaacagatcagaacaagaaaatgtaaagcctcagtgaatttcattaagttgctcaacattacacaactccttttttcatagtacttaaatcaatttaatcaataattaaggcataattttttacctaatgtctgtgtgctctggtaaaataaaaattattcttggccactttgtagtctccagaatctttccttgtatttgcttttgataaatatttgttgtataaataaatcaatgttttaggaggatggattgatggatcaaaagaaaataggaaaatctgacgaaaaattttaacacagttggctgggcacagtggctcacccctgtaatcccagcactttgggaggcagaggcgggcggatcacgaggtcaggagatcgagaccatcctggctaacatggtgaaaccccgtctttcccaaaaatagaaaaaattagccgggcgtggtggcgggcgcctatagtcccagctacttgggaggctgaggcaggagaatagcgtgaacccgggaggcagagcttgcagtgagctgagattgcaccactgcactccagcctgggcgacagagtaagactccgtctcaaaaaaaaaaaaaaaaaaattaacacagtttagtaggatatggtttctcataatgtttttttctcccaaatccaggcatcgtaaaggttgcctctattttctgttttagtttattccacatatcaacatattttcttcctggattaggttcctgtgtttgctgtaccaagcaatcacaaacttaatggcttaaaacaacaggaatatttattctctcacagttctggagggcagaagtctgaaatcaaggtatggcaaggcagtcctctctctggaggctctaggggagacactgattcttgctgcctctaacttctggtggctgccagcattcttttcaccgtttagcctgtggttgcatcactccagtatctgcctccatctttagataggctctcccctgtgagtttgtgtgtcaaattctctattcttttaacttataaagacactagtgattggattgatggactgttcagataatctagcataatctccctaggtcaaaatccgtagcccagtcacaattgcaaagacaccttctcctaattaattaacacttacaggttccaagttttaaaagttgatatctttgggtagccattatccagcctacgcctcctcccatatatcattatatatatcgaggattttccatttgcagatatggaggaagttaagcctacagaaattataaactgaagttgctaaatatatttcttcccttggatcatgcagaaaattaaacttgtggaaaaattcattttaattcaaaaaagttaaggaagagaattttggaaattgtggaggagtttttatttatactgaattctgtatgaaatgtcatattcccatacaccattcattaggaaatagttaaaattttgtgcatgtattagtaattattcctcatgacttcccttaaacttacaccttacttgaatgtctcatctctacttctcaattctgaagtaattttcatttctgacttgatatttattaaccttacacttaggaaagagcatagaaagaaaattgactaaagcaaatgactggcctatttattggctgaataaatcaaaatagagaaattagaaactccaaaattatatcttaccttaaaaatagactaataactctcaaagagaattatgattgctctttgtgaaataaaagagataatagattgagaaacaaagaaccttactggcctacagaaaggaatatataaaattgatgaaaatgatgtctttgagattctcataaaattaactgctttttaaataacattttaatacccgttattgacaaattgctgttctgggacttctgaaacagcagccacctgggtttcttggaaagtttgctctgtgtgaaggtagctggcatggaaagagttcacatctctgagaccaccatactctgaggaagttcaaggtactacgaagagatgcaaagaagccttcagataaccacactccactcatgatccaactgtggcttcattacctaggtgaaaaccatgcagaagagcccagttaatccctagaattgttaagagattatactaaatcatcacataattagaacattttcaacatgaaaattatgactcagtcataatttacttactcataatttaagtaaatggcccaaggtcacataaataagtgataaatttgggattcaaacctagtttattcatcttaatgcatttttgtacccatcctcttatacgatttccttatgtggcttacttttgttgttgtttttctcttccactgcaggcaacctactgaggccttttcacctcatgaactagtttctccatatatatagttttccatctctttccttctcttccttcctcatcattagaatcttcattatcataacagtgacaacttacatttagtaagtctgaagtaaatgacagacatctagcctgagatatgtaacaagaatttggcacctctcgttaaatagctccccaactcatcccccacatgagagtcaaattgtcatatctagattctgtgtttaataaaccacactttacttaaacatttccttttcttttgggatagagaccatattctctatggcatttttattctagaaggcagtgtggaaaataagcatggatattgaggtaaatttagctggtaataattgccattaaaaaataataaattaagcaatgtacaggttgagcaacctaatctcaaaatgaaaaatgctccaaaatccaaaatgctcaaaaatctaaaacatttcgaatgctaacatgagatcataagtggataattccataccacacttcatgtgataggtcacagttaaaacacagtcaaaactttgtttcatgcacacaattattaaaaatattgtataaaattaccttcttgctaaatatgtaaggtgtatatgaaacaaaaatgaatttaagtttagactaggctcccttccttaagatatcttatgtatatgcaaatattccaaaacccaaacaactctaaaatacaaaacacttctggttcggagcatttttggtcagaaattctcaacctgtagtagaagggacaccatgggcagagtgaggcaggagattacttagcatatagtgtcagatagggctgtctaagaagatgacagttagtctgagatttgaaagatggaggctgggagtgatgactcacacctctaatttcaacactttgggaggccaaggcaggaggattccttgaggcccagagttcaagactagcctggccaacagggcgaaactctgtctctaccaaaaatataaaaattagctgggcatattgttgcacgcctgtaatcccagcttcttgggaggctgaggcacaagaattgcttgaacctaggaggtggaggttgcagtgagccgagattgtgccactgcactccaacctgaggacagagtaattcaagagactaaaatggtgggtttttttttgcttgggatataatgattaaggaggaagcagcattttaaaaaaatatgttatagagatttttgggggctgtgtaatattaacactgcagtaataggaaatttgacttttataactagtatattttaaaaagaaatgaagttgttaaataaaggggttagcatggtatgatttacaactgctgttcagcagggcggatgcagaagcagggagaccatgaagcgacccttgtagaactgaattaagagctgtttgcaacttggaatagatgatggcaataaagatgaagaagacgaatgctggaatcaataggatatcctgatagatttggatctgaggaatgaggaaaaagaaaagaacgaggaaagtctgtgaacatttgctgcaaggagctgtagaagatgggatccgcttacagtaattagcctgagagaatggagaaagcatttttgaagagctctgttttatttagcttaagaggcctattgaaatccaatatatgaatgttaattgtttaggcaatagatatatgatctgaacaagagagggctgcttggaaaacacctgcaggtagagtgataggactgaatggaatctttttgtgagaaagatagagaagagggtgcagggatgattcctgcaggatgtgcaaggtgagagttcagagtatgaagagcgagcaggtgatagagaagggaagaaaactgatgtaagcaaacttagactgtgttttttctcagaatcaagtaacaggatctctgaattttccaagctctgcatgtgtgcatatatgcctttgtgtgggtgtgtgtttatgacatttaaagcatgttgagggccaagaaatgttcattgcttttagcgacaagaagaattgaagtctaactaactctcttttaaattatttttctcttggataattcattgtgactttctggatgcttatgggcactcttgcttctgtggaaggctctgaactgaattcctccagtcttctttctttttcacaactggttgacaatcaaggccaggcctgaggctcaccagctgtgagtactacacgttgtgccagacagtgctacttgatctgcccgtccttagagccacagtaatggccatgtagagcaacaatccgcatgtgctgtgcaaacatcgctgaaaacaactctgaaatacagtttcgctcagttcatgtgtccacgagaaactctgagatgacaaaacgtaaatcttttttttttttttcattaaagtagataaatccttcaactggaagaaaacaaaacagaaagaattacttcttccaagtgtagatctatagattttggatttttttcatttctttttttctttatgaagtggaagatgcaaaaaggggctgatcaacaaaccctgatctctcaactggcccatcagtctgtagttagttaaaacacagaagccaatagtttgtgacacaatgctgttaagtgggaatgagggatttgtttaatacaatttaaaatgattttgtggtgtgcctcatagtcataaaacattttattcaaaacatagagtataataaatacaggtacctaatattaatccaacagaaactatacattttactattaatagacaagtgaagatctctctccaatcaatagagaatatcagtttgaagggacaagcgatgattggctgattaaattgacaacctgcactcaaccagctgaccattcttagtgaaataattcagagtgacagccagatttctcgatctggtcctgtttgtgtgtcaatcacttgccaatacttctgagtcactcacagatttccatgcaactgtgttgaaacaacctcctttttcatttttttcattttttttttttttttgagacatagtctcgctctgtcacccaggctggagtgcagtgacgcaatctcagctcactgcaagctccgcctcccaggttcacgccattctcctgcctcagcctcctgagtagctgggactacaggcgcccgccaccatacccagctaattttttgtatttttagtagagacagggtttcattcttaattctacacattccttttaaaaattaatttctttctaactcattcagtctattcatggttctggactctccacactcctgctctcactgggcaggtagggaaagtctccacattgatgaagtgctaatccctcgaccctcatcatagccacgctagcattggcttcagttgacctgaagtgtttgggagaaaagtgagagatttaactactttaacctcaatattgacttcactgcttacaaatatttaactgcctgtatattaatatatcctttaatatgtccccatgtactgcatgtgtgtgttctgtttctgtaattagattataaacccactggggacaaagccatttcatgcatttttttaaacccctagtgtatattaatacagtgacttgcaaatcgttgataataaaaatattagctaatggtaaaaaagaattacaactagatatttataggcctctcttttactagcttaggtaaaaattatattgaattaattcttatgtgccattaactccttttaaaggtcttgaagctataaaataatacatgtttattgaatataattatgcaacatattttaagcatcaatacatccatttttgtgaaccatagtaaattaggtgtactatcttacaatgtgattaattttcatattcctttgtattttgatttgggtatttgttatatttttccattttcagctgtatttgttttacttttcctcctaatttttaaattacttgagaaagagtgaaaatctttaacttcatgtgtaaactttcatagcagtgaaagtattagtctgcagtgatagtactcaatatatgtaattgatcattttattaattgcctgtctctgtaaactttggtcaaagtaaatttgtttcacaagagtatgctgaataccagccaagatgcataagctgtttcctaggggaataacttgcgggcccatggattgtttatatatttttatgatgttgggtaactgttccataacattaagtttctgtgtttacctgaatacttagaagaatataaaagcttcttagccttaaacaaaatatttctgaaaaagaaatcatttaatcatgcttataaagtgaatgagaaatacaataagtatgattctggcaagtctcaaagcaaaatttctcagaaaaaaagaagtgatagtctcaccattctccctaactagggaagcacttttatccctatcactcataaagcaataacactttattctcacagtattctttttgcaaaagaatgtaagtgttgacaaaaagagtcaaactctgtaaaatcttttaagagatttattctgagtcagatatgagtggccacggcctgtgacacagccctcaggaggtcctgagaacatgtgcccaaggtggctgcggtacagcttggttttatatattttagggaggcatgagacatcaatcaaatagatttaagaaacacattggtttggttcagaaaggcgggacaactcaaagcgggggcttacaggctataggtaaatttaaacattttctggttgacggttgagtttgtctaaagatctgggattgatagaaaggaatgtttaggttaaaggtaaaggattgtggaaaccaagttttattgtgcagcggaagctctcggatagctgagagagcagagagacagcaggttgtaaattgtttcttatgggacttaagagggtgcctggttcttagttgattatctcctggatttgggaaggaaggaaggaaggaaaacagaggggtaaggggattctatagaatgtggctatttcccacaagagacttggcagggcaatttcaagttatggcaaggaaatatattttggggtaaagcattttgattttcttccttgttatgccagagtcagattggaaagtaagttacgatatacagggctaaataaatcccacctgattagaatttatggtttgtagggcatgagtccccagaccccttagaaaggaatttgggtaagataaaaatcagaacttagtcctcatgagagtaaaaaaaaataaacacacacatgcacacacaaagaaacagaacaaaacttacatgttagctttctttttttttttttaataggggaatttaaatgtgacactcagaacgttttagtcatattaaaagtgcaccagatttcaagtgtagatataatccaactagacaaatactctcctggaccactgtggctctagttctaacatttagctgttttcctcataaccaaaggattccagtatactgtagcagattataaggcagtaaaatggattactcatctcttattcctgcttaatatggtgcatgtttaagaaatagagagccataggttatgtattttatgtaatgttatgggagataatattatcaagatgatgtttgatccttaacataggatctttcttctctatccccattccaatatttgcatttcaagaatgcccttatcttttgttgtctggagttctgcagtagtctattaacagctattaagtgtttacaatcacagtcaccttaattctctccttcagctactgccaaaatgagctttgtaaaccaaagctcattcttctcctttagtccccaccactggaaactctgtaagtgtccctaggttgctttccttgatttcatatttaacacgcatatttatttcattgtacaatttggactgttgtgcatatttctagtattttatttatagtaacaatttaaattttagaccagaatgttccaacgtattcatatgtccattttctgaaggttaatgcaagtttccaaatcaaatattcaactataaaaccaaatagaaaatactaagatggtaatgtcatcagtttctaatgtgcttgagttattttcatgtgtatgataatttcaagaacccctgtgtaacctgattagcaataacaacaacttcactccaaaattttggagaagtttacagatattgcaaaaatgtgtacttatttgccaattgtttaatgcatcaaacataacaaccacatatttttaaaatatttatttggtaagtaagtaagcattatttaagaaatccatatcatggtgaaaagaattcactgtgactttccagacaacttataggcaagtttacagggtatcaaaaaacagcattcttttatgttatcagtttattcaattcacttattaactgatcattgaggaaatgactttcctgtttactacctgtcacctagtgagttaacacctgtaatcatatagaaatagtaatcagactacaatgattatttttagtttatttatatttgggttaattttcatttaagtattgttattgataggttagagatgaaacagcttgagtgaattttttaaattataatttaataaaagaagctcaatgctcttaacttggggttactgggattttgagacgccagaacaagtggctaaagaaaactagagactcatttgataagtatcaatcaattcagctagcctttttttgttgctgttacaggaaatataatcaagcagcacataggtctgtgtattcccaattatcattcaacactccataactgttatttataactctatggaatggtaacatttgggaggaacaagtgtgagcctctgaagaaaggctactaaggaaaagagaaacagctatggtcatgtttaagctcgatgtaagtacatttatgtgttaccttgtgccaggatatgccccagtatttgatcgaatattattctgtgtgtaactgtcaggggcttgttgatgagattagcatttgaatcagtagattcagcagatggccctccctaatgtgggcctcatccaatcagttgaaggcctggatggaacagtctgaggaagacaatttcttctccctatctatcttcatgctgagacattgatttgctttcctgccttcagactcaagtggaaatacaggatcctcctggttctcaaggctgttgacttctcagactggaactatgtcattggctttcttagttctcaagtcatcagatggggactggaactatgccactgccactcctgggcctctagcttgctgagtacagattcatcactgcttgagtcaatgccttgaaataaacaaataaatccatctcattggttctgtttctctggagaatcttaatacattctgtattctaatataaattgaattcaaaaaaatgcgactaaaattcatttaagtgaagaaaattgaaaatgtataatttgactttcactcattttttacatttatatttttatcatgtgtttagtaatcattaattaattacttattgtgagtactgtgtgctaataattgttcaaagcacatgagatggtatagtagcgaaccaaagatcccagccgtcatagagctaagttaaacagtaaataacaaaaacaacatataagtaagttatttgtatattggaaggtgataaatcattttgtgaaaaagaaaaatatagggaagttgaaggggtcaggagtgctgagggcaggcgtatttagacatttcacacagtgggtagaatggtcttcactaagaagatgacttccctgcaaaccttaaaggagtgtgaaggttcgttacacaaataccttgggaataatataccagatagaagagccaatttaaaggttctaaggtgaaacatgcctagaatattcgagaaagaatgaggaggccaatgcatcttgggcctgaatgatctcagttggaggtgaaataggataaagccagagcagtaacaggggaagcgagctcatgggccttgctgaccagtgttaagaaataagcttttgcacagagtgaaatgggaagttattcccaaggcttgaaagcagaggaatgatgtatttagtgattgctttaaaaagaacactctggctgctgtcttgcaaataggctggaggaaggaaagggtagacgcagttagcacggctggaggtaatggcagtaatccaagcaacagatgagggcaaagcagaggaggctgactgcagtagatgtggtgagaaatgcctggattccaggtattactcaagatatttcctggcaggaagaagatgggctgtaagaagggtcaagggagattctgccaaattgttagcttgagcaactggcaagtggattgtcatcaatgagtataggtaagatagtggataggataaattgggaagaacaggagtgaaattaggggattgtttgtttgttttgtctattagaaaaccaagatggagtaatcaagaatgctgctggatatgagtttagaatttgggaataagatgtgcttggattaaacatgtgagagttatcccacagatgggacacgctcctgaatgtgtcccctttgctatgcctccctgggatgcccttcctacttcttcttcaaaagccacgaaacttaaacagattttcaagggagtcagtgaagacactgagaaaacaggatgtggacctcatctttgggaataaaaggagaaaccaggaaagaaaagtggaaaacaacaactagagaaacacgaggaaactcaagagaatgggaacttactggagatagaacctgagtgaagtaagtgtgaggagaagagtaagacattgtcagatgttgctggcaggccaagcaggaggaggagcaagaaacgaccactgaattcagcaacgtggggctcacgggcaacttttatgaagcaagttagaggaacagtgggattgaaccttaatgaattatgtttaagtgccatgtatacattcccatcatctcttttaacttatgacaattacaccaaaagattttagaagtcaaattaaatttaagagtatcttgtttcttgcctgggcttcttgacttttagatatgtaaaaatagccaatatagatgtattctacttccaatgtacttgggaacatttcttaaataaaagaaaataaagtggaggactgttttctagttgtagagtttgcatttgcattatgtaataaagagtacaagcactatcttctattaaagatctccctatgaacctatgaggtccctaaatctctgacattaattccattctcctacatgttcctagatgatatgactatgctttagcaagttgttactgaattgagtggtgatcgatacgttatgtccaataatctccactattagatcaatctgagtactttatttaggtggctagtgggagctgcgtgaaacaggacagagacagacataagcaacctgagagtggaaaagagcagggcactcctaaatatggccatggatgtctacagcatcaaatatgtcataaaaacaagaacaatcataatttgatttgaatgtagtaattattactatcacataaacttatgtataaaactagctaaatctaatcccttgatatcttataatgcgccatctcaatatatgagctacaaatattaaagtgatagttctggtcctcagcagtccccccaaactttttgcctttttggcaccacggaccagtttcatggaagataatttttccatggatggggggtgggggtagggggtgtggtggggggagggtatggtttcctgatgaaactgttccatctcagatcatcaggcattagttagattcttataaggagcacacaacctagatccgtcccatgcacagttgacaacagggttcgcgctcctatgagaatgtactgccccagctgaggtgacaggaggcagagctcaggcagtaatgctagttagcccactgctcacatttgctgtgcagctggttcctaacaggccatggactggtactggttagtggctttcctatatcttaaatatatgaaaggatcattatttttaatgtccttcaataccacatggcataattcctaaatgtcaaaacaatcaaaccactgtttaggatgatgattatattttttgtgatataaataccaaaaagcagatttaagcactgatataataaatcaaatcaactcgaatgggtaaaaatcatttaaacagatggtttttccaaattctattttattcagtaaatataaattatgcttactagaaagttcaggactaattgattcttttttacaagttcataaaacaaagttgaatctgttcaactcaccatctcaagaccatgtttgtttgtgcaaaataaagtaccccattttaattctacctaattatatgttttgcagttccataaatatgttttttcaacaatgcttctaaaacattactttcttgggaatataggtgtacttttaaatatcataaaatttttgggcttgctatagtttatttcatatttaaaataatatattttctatattaattgctctaagatgactttatttggatatattaaacagaaaagaacttctaaagatgtaaatttaatatgttttctaagtattttattattcactaaattaaattcatgcctttaagtttctctctgaaaacccccatctttctttctttgcttcactgaacaccctacagcttcccaaagggaaaaataaataaaggctctaataatgagtagtttcccaaggcacatcttgtcttgatttggaatacttttaatgaaggcaagaataatcagtctccactgtgtttatcaaaactttggaactttgcagtacactttttttctttgaaatatataaatgattgcacaggcttcctgttcaaatcggtaaagtttcttttaactatttgaatgatatgttttgacaaagagtctccaatgctttaatttaaaggcaggtttatgatcaataatggatacgattatgatgagtgaaggtttactgatttccttctttgcttgtcacccagggctctgtgagtggtttcctgtctctatcacacttgtctagttagaatgtattttaactcttctccccccatgtctaattctgtaagggctgaacacaaaattaggcatatgtgaaattttggttaattttatttgttgttattcattataatgtgatttatttcatttacaaggttgttcaggaagagggcagcaaattggacaaatctttgagttatacacctatgtaaacaaatacaagaatattttaggctactcacaataccaacctgagattagttgaacccttaaatccaactgcagtgaaatagaaactatagtgaagaatagacgtctagtaaagtgaggaaataaaacaaataaaatcattcccagatttctcaactgatctgtcttgaaatacttggaacgcaacctttttcctctgtgtgttacatgacccctttttgataaattaggttaatttaaaacatagaattaccttatcatcaaataacacatctagaaaaaatgttgaacaatcatccatccaatcaattatttcatcttcatatctaaaatactcaaaacttattatttaaacaaattcctcaagaaaagtgcttgaaaaagaaatttatttttaaacaattggaattcttttgtgttacatgtgtatgcatgtatgacatcacattctctataaaagtcataatcaaattattgaaggtaattaaatggtcatcttgaaaaagatgtttgtgtatcattcttgatctatgctcatttatttttacaatttacataggtactgaagtggagattaatgtggcttaataaggattattttttatcttcttaagttagattcactctgctgtttacctgttattagtaaatcgtctcccccaaaacaatgacaaaaaacatctgtaatgacattggcaaataattaaccttatatgggaaatataatttatttaataattgttaatgttaatttaataaagttaattgtatgtcattaatttttactagacattttatataaactatcaaatgtaattttcaagttttcatatgataaagcttaattaacatcacattttaaaaatgaatctgaagattaatttattaaaataaaatctgcaacattatttataggaaacactggaactgaaatataaattcacagtaaactgagttcaaaaatttatgaatgtttttgctatgttgtcatatctctattaaagtacttataactacaagatgtggataatttcagtaatcacatactgcaatggctcagtctgaataaataatctacattcaccaggactacaccgtgcagtagtaaccggtatccacatgtggctattgaatatggctagctgaactgggacgtgcagtaagtgatgtaaaatacatgctaattgcaaagtcttggttcataaaaataaagcaaaatataattaatatttcagattggatacatagtaaaataatattatatttagatatatagagttaaataatatataattaaaattagttttctcttttttgtaatttatttagttttgaaactagttttaaaatttaatttatttaaatttaaagaaattcttaaatttaagaagatacatttaattaaaaattatacatatgactcatatatgtgtggttcacattctattactgttggacagctctgttctacatcacttttgtttgcaataaatgacattattaatgacaacaatgctgaatgaaaaatcataatggagaatacaaaaattacacacattcgagaaaaatacctgtcaaccttttaagtttcttatacatgataagatctcttgaggtttctatttcattttccctgggacctgggggaaccacactcattatatgcatcacgtgcagtgacaggtgtagttacagctgcaaaaagatctccttttatatctcaatttccatgttctgagaatgaagaatatttcacctttcatctggaaatttgccattacatagcctcaggccaaaagctttatttaaaaaaaaaaaattcgtaaaaattgtcatgagtggcaaagacacacttttttttcctttgccaaacattccgaataaatttactttattaagtaaattaaaattatgaatatataaaatattcaataaggacaataaattttttacaatgacatgcattatatttctatcccagatgtgatttacatcatcgatcagtagtatctcaattattcaaaatgagaagaggaaagcatgccgtgaattcccattagaaatcttaaacagttaatcatgagctctttttacttaagatgataaagatcaccctttgacttagcttattatttttgtctttctgtccataatttactagttgtttatgagaagccaggcttggaaattttgcttcggggcaagcagttgtggaaattattctgccctctagaaatcctgtgtttttttttcttgcatgatgggaagctcctaatgataagtgctggcttgagaaacccataaaaatctttgttcatttgaaatagctacaagcttttaggggtctttgttgttcagtgtctactggattatggaagttgtaagagggaatagacaaagtctcagaagtcttagtagtattttatcttatagggattggggtgtcacatatagacaaaggtgtaaggtttcatcagatagtctaagaattactaaggattatgagcttaaccacagacaggatttatacaggtattcatataatgtatttattgagttgttgtttattatgcgttttagtcatgctaagtactgggagataaaaaggtgaaaatctaacagtcacaatttttatttctagaaggatagtaacttgaaagattttctcaatcaaaattaataaatgatgaataaaattcagccaaaaactttgtaatccacaaatgagctaacaaaatataaatgaaatgcaataactaaatcaaagagaaaaacataaccctaggagataagagagcaccaaggctaatattaaccctgagggtttgtgttctttagtaagaataaattatatggtcacacttttctttttccattttatcacaatgactgcggaatatacttgaaaagcaacatgttgacataattaaaatgacatttttcattaagaacatctttatatcaagcagtgtccattaatatagtaatcagccaagtgcagtgtttctctaaatattcctttccattttatatgtttaaaaatacctagcagcgtaaaaataacaagtcctgaattttgcctccagaaggattatgtttcagccctcagacacataatatggaataaagaattttagatgatatgagtcaccaatgtcaatcaattttagtgatatggtttaaatatgtcctccccccaacacacacacaattcatacattggaaagttaatctccaatgtaatagtgttgatatgtgggaccttaaagaggagattagatcatgaggattttgtcttcatgaatgaattaatgccattattctgggagtgggtttcctataagaatatgagtttgacccctttccctttcttctttgcccatgtgatgccttttgccatgttacgatgcagcaataaggtgctcaacagatgccagctccttgcactgacttctcaaatctccagagctgtgagaaataaatatccattgtttataaattacccagtgtggggtattctgttatagcatcacaaagtggactaagacacctaaatagatgatgccactaaaaatacataaaaatgatgtttggaaactcttgaattcatatgagtgagcattgttaagggaataagggaggtcataacatacagaaaccagtaacagccagacactgttaacacccctagggctgatgtagtaagtaaggaaataacatagcttttgcacatagaaagggggacactgagtaggaccttagtcttggtgtgatgctatcaacagaggcgaagtggctcatgcctgtaatcccagcactttgggaggccgaggtgggtgatcacctgaggtcaagagttcaagaccagcctggccaatatggtgaaagcccatctgtactgaaaaaaaaaaaaaattagctgggaatggtggtgcacacctgtagtgccagctacttaggaggctgagtcaggagaaccacttgaacccaggaggcggaggttgcagtgagccaagatagcaccattgcactccagcctgggcaacggagagaggctttatctaaaaaaaaaaaaaaaaaaaaaaaacaaaaaacaaaaaaacacgcacacacacacacacacacacacacacacacaacacagaccaccaaacagaaacaaactttccccttaaatactgtgctacactgagtgaagtgatgaagtgatgccttgttttcttctatgtagaaaccaaatattaaaataagaagcccaagtaaaccaatgttctatgccagacagaacaatgaatttcttattgtctgtgcttcttatattagataagaaatttgtggtattccatcagtagaaattcatgctgaaatgtattaaaaatttacaaggcacagtaggtataatgaggttattaaaatgagtaaaatgtggtcccttttctcaaggattttatttgaggggaaataacacatattcaataatgtcagacacaatgtaagtattgaaagagatttaatcacactattggtaaaagcatataaaaagataatttatttctgaatggaagtatccagggaggcatcagaaaaagctagtttttgagtagagaatgaaagtcagaatcaggggaatggattattctacggagagggagtagcatgtgaaaaataatctcagaataatacaagtaagtcaggagaggttcaggtattttaatatctaaatcagaatatggggtacttttccccctaccagaagataaaaccagaaatggaagttgtggccatattttaatagacctgaacattatatttagaagtttgttgagaataatgaaattctttaaaggtctatagtgtagcagtgatatcagaatgattaaataatttattatcacttctaattcttacattatttaaaaattattttaaattacttattatattctaatgaacagtgagaaagtatatgatatggtttggaactgtgttcctatcaaatctcatgtcaaattatagtccccagtgttggaggtggggcctgctgggaggtggttggatcatggatcatgaatggtttcgcgccatcctcttggtactgtgctcacaacagtgaatgagttcttgtgagatctgttcatttataagtgggtagcacccctccacctctgctttttgctccagctcctaccatgtgagatgcctggctccccctttgctttccaccgtaattggaagctccttgaggcctccccagaagcagatgccgccatgcttcctgcacagccaattcaacctcttttcttataaattacccagtctcagatatttctttatagcaatgcaagaatgacctaataaatacagtataaaataaactagaaatgcttgagtaggaaaacattacgcacaaaaatatgatttaattatttgtaatataaatgcatgtcataatgcttgcaccaaaaatagtatgtgccagtaacatatttgttattgaaaacttcattactagatgttgaaatgcttttgaaacaatggtatttttccgtaatacggagacacccccacatgtgccttgtagaccaaaaagtatctgagacaagcctcaatcaatttagaaagtttattttgccaaggttaaggacactcccatgacacagcctcaggaggtcctgatgacatgaacccaaggtggttggggtacagcttgcttttatacgttttagggagccataatacatcaatcaatatatgtaagatttacattagttcagtctgaaagggagggacaactcgaagtggggggcagagctcttccaggtcataggtagatttaaacatattctgattggcaattggttcaaacagttattatcagtagcaaagaatatctgggttaagataagggattgtggagatcaaggttttctcatgcatatgaagcctctaagtagccggcttcagagagagtagactgtaaatgtttcttaacagattgaaggtctgcgttgatgttaatgctggaggtgtataaggaggcatggctgacccccacttcctatcttggcctgaaccagtcttttaggttaaattttaaagtgccctggccaaggagggagttcattcagatggttgtggtggcatctttgagttttattttttatttaaagctctaaaagatgtagcaaaattaaagtttggtgccataatttgtaaactaaaaaaaaaaaaaaaagcaaataacaggtatgtgattaaaatagtgatattcccaaaaggaaaaaagagacatacagacatttacataatttcaaatattcataaaaccaacactaacatatacaatacctaggttaaaaaattaactgaattaatacttcaagctgttgcttctcagacttttattgtgcataagcatctttttttaagacacaggttcagattcaggaatctgtagcaaagcctgagattctcccaggtgcttctgcaggggctgctgctgctattagtcaaaaggctgctcatggatgtcaagtctccagacaacctccttcacccctttctgtgttaccctccccgctcactagaattaactataacgctcaattttgttttgaagaggaccttgattttccttacatcttaacacctaaatatgtatcccaaaactttgtatgggcatatgtattacattttatctaccagtttcaaaacttgcttgtggaaaattaggttttttattacttaatattttagaggtttacttatagctaattataactggtccatttattatcctgctgcatattattccattatatgattatactgctacaatttatctgtttgtcttttgccagcatatataaagccaacaatagtattacttctgttatgaaaattcttatgtgtatgcccagaggcttgtgtgcaagagtttctttggagtatgtaaggggaggaaaatgactggaccacaatatgatatggaacctgactcaatttttgatgttttggcgctgacagcttttaagcctcatctctttctgttcctttctgagcaagctaataagaaagaactggtgctttctcctttggcgcttctgggaagttcaaaccttgaccctggccccacccgctaaaccccacaaaaatcccaaattagttttgtttctgtgtgcacttaagttatttttggatcagcttggaaagtctgtcttgtgtctcccaaaatgtctcattatatgaataagaaaactttgcctattttctcgggtatgtgtgtgggtgacattatcagtcttaacatctgaaccatattttggaacatatccgggttcaatcctcaagatggccataacacatagggtaagtaagaaatttcaagtttaccaggtagtgtcaaattattttctaaaaagtttgtgacaatttgtaatccagtcagcagaggatgagaagtctcatttcttcatgtactttccaatgcctgatactgttaaacttttaatataagtgcacccagtgattacaaattggatctcatcgagtttttatttttaatttcctgaattaatactgaggttgaaacattatttttgtgtttcttcatcacacgaatttgttagtattctttattctctgaaatatctatgaatactttgcctcttttcttttaaatctaattagtattgccttgtaggaattttaactatattataaatataaatatattataattttaaaattaatataatgtgattatttttatcccatttagtatctatatcctctatcaatttatagcatttttaaatttttaaatttttttcatttttttaaagacaggttttcactcttgcccaggctggaatgcagtagcacaatcatagctcattgcagcctcgaactcctgggctcaagtgatcctccagcctcagcttctcaaagtgctagaataacaggcatgagccaccatatgccacccttacagcatcttttagtgaacagattttctaattttaatgtggtaaatttatcaattttgtcagctttttgcatcgtgtttttgtatctatctcttcaaaaagcttaatgcttcaatattacattcatacatttaaatgtaaatactgaaataatataccacttactaatatgcatatgatgtaaagaggaaacaattgaacccctttcatttttttagaaatgtttatttagtagtctatcctttcctcattcatgtgcaatatcatctccaccatataacgtgacccatgtaaacctggaattgttgctaaagtctaaattggattcaattagtaaatttatctatctactttgcttataaaaatgcttagttactatatatttttaaaatgctttgatagatctagtacagataattttcttcacattatttttgtcttgaaaggtgttattcttggatctttattgttccacttaaaaatgtgaataaattcccccatgttttaaaaataaaccttatgtagaatgacactgaatcttcagatacactttaataagatttacgtatttaagatataatttctatctctatttgtttaagtcatatctatatctataatattatatcatctttttcacagggctgatatgtatattgtatgtcataatttgtaatattattaaaagtatcacttatattaaatgctctcaacttgttgctgtatagaaaatcaaatgagctttacataaaaatcttaattccagctatatgttttatttcaagctcatcttagataaatcgtcttgatttttgttcatagaaaatcatgtcatcacctctcaaacaataaaatgtactttagaatattttaaaacatgtattgaccttatacattattataaattttagtatttcatttttagttgcatcccttttactagttagacattgtcatcatttttaaatgacggtgtccatttggatttatccacgtgcttaccactgtctttgctgttatatttcatatctcagactttccatctaggatccagtttccttcctgaatttcaaactttggaatgtcctttatttgtaaatcctttctgttttgtctagaaattactttatctcatattatttattgacatttttaaattgaaaaatgtcattgaaatctgacaattactaatgtcaatttcataaattattgacaatttcatagaaatctggtgcaaaaaatgttggttaatgccacacattaaaattcctcttttactacctctggcttttactgtttctgttttaaaaatcagctgttagtctaattgtcatgccttgcctatgaattgtccttttctcaacttgcgtttaacatcctattttcatctttgatgttttctaagttcattatgatatacctagtgctaaattcagttgtctttttcttatctgtgaagcgatctactttcttagcctgaggattggtgtctaccaccaaatctggagtattttcaactttgtctcttcagcgtctgaaatatttaccatctgactctatggaaagtactttgcaacccctgttctacatggataactttttggattcgttttcaggttcaaattttatttttcacactctaattagcagcttaaagtgatactgcattttcaatattacaaattataattttataattttttctcatatttgaattttataattgtaaaaatttaatttttatttggcaattaaaattataattttataatttcctctcatatatttgaaagttttttaatgtagattttatttcccaagtcttttgttttttcataattatagaatcttctttctgaaattttgtctttgaggaaaggggtgtaattgcatttctccacaagaatattcttattctgggcatacatgatatctaaccctttgtttcagatttaatggatcatagtagccatatgaattttgacggaatatttacgaggactaactgtggttatgaattctcagggtaaatatatttctcttccatccagtgccaaatttaagatagagcatttttcttttttgtctacccttattctttattttggctctttgtggtgacacgtctgtgtggaaagacctctacaaggatgtatcatagggtttatatctgtcttccaaattctatgcagccttcagtatttcctaggtaaaactgggctgaaatcttcaaaatcagaaatatctgctggactatatgaaaatatctgctagatcaattgagttatctatagtgaggtaaaagcacagttccccagagatggatatagtttgatcttctcagttccatactaagaatatttgatgatgtctttgcttctatattttcagtcatgccatttcctaccaatgtatcatatgtatatactgtttttaaaagttgctcctttaatttcaagttcttctctagtttgtttactctatttttacaattttatgatagttaatcaaaatagttgcatactatctaattccatagctaaaagtccatagtaatgatttctgaataacttatttttattcattttacataatctttcatcagaagttgacactttttattctttttcttcatgactaccaaaatatccctcttctctcttttttatttttctgatttttattttcttcatgttcaggataccttatcaacaatttgatagtttttttcaaaatcaactacttaaattttcaatattagtatgctccaatagaccatctttgctcataaggatatgttcctttcccccagggatgctttcccactcacataggcccacattttactttattgctaatacccatcatagctgtgtctattgtttaagaaccaaacactcatgttcatcatctgctgactagatttttttacgaagaggcatcctccattaatgtacaatatctttttctaaatgtgctcttttcccatctagattttaaaattatggatagctgggaaaatgtcttatactatttttgctatcatctggaccaattagaatgcatttggagaggaagaaaaacattcttctatcttaggttagacagttacttctaacaaattagaaaaacaaaagtcaaattaacagaagaaaacacatgcaaattttatcaaatgctaatgttttctttttcttttttttaaaatgtgcacataggtttttataaaaagtgaagacccaaagaagtagttaaactcgggtgcttatatattatcctgacaaaggaaaataaattatggagaagcaacaaaacaaaagaaaagagttgtgggtttcgtggagcagaaaattttgggaaggtaaatatctctgaggaaaactagtagaagataacgtatcagtaagttttgtttatgcagactcatgtcagtgtcatgtccaggtccagtgataaaggctgtttttcccatcctgttacaagaaagggaggcatctgcacaaaggaaaatttattccctgtgttgcccacatgttgacataactagcaattagattgattagttatcttggccagggtttggaaaactggtgcaaagaggggtgtcacgtttgtgcttgacttgttgagagaatagaaaagttaatagatgcaagacactgtttgaaagagagctcatcatgggggattagagggagaataaaatagattgagacaagcaatctctagtcagccttttgataaatgggagatataaataagtgaggaggagtttgtttcaaagatcaaaagaggttgttttgtttttttcccatcttaaggaggaggaagatatcaagggggaaaaaaactaggtaaagatgaaattctgaatccatgatcaagagctgcctactttgaggtgtttttacttccagaacctgggatgtgactctgaaaatcttcaacttaaagtctcctacagaaatagacttttacttgttttgagagtgatgatataggtctagattggcatggcaatgtaggtagttaacaatattttatggaggccgagcatggtggctcacacctataatcccagcattttgggaggctgaggcgggcagatcacctgagatcaggtgttcgagtccagcctggccaacatggcaaaaccctgtctctactaaaaatacaaaattagccgggcatggtggctggtgcctgtaatcccaactactcgggatgctgaggcaggagaatcactagaacgtgggaggtggaggttgcagtgagccaacatcacaccattgcactccagcctgagtgacagagcaagactccatctcaggaaaaaaaaaaaaaaagaaatctcagttactaacttctttttcacttttgtattgacatgcctactgggtggcatccagtctagccacaaaccctgcagacagccaaacagtaagaagaacctaaagctggagatgaagctatgaaatcaatttgtattactgcaaggggatgtgagggccttggagatttcctcagctatgttggttttcttcggaaatttggtgagatttgcaagcagtaccctgggaaataatttagtcagaatttttgtggatggcagggtagagccaattgtcttttagctccttaactatcccccatcaacaggtatatttttatttgatgggagataagtgcaagccaaaagttcaaaagagagagggctataggaagcccatttagtccattgtttaatcagtttgataattatttggcatccttttgtatccatctgtcttcttcatattatgggacatttctctgacagttaataataccagtcaaggatagaggcagatgtataaattgtgtagtaaagggatagaggagtacatgtttagctctgcacttagcagctttgtcagacttttattttctggagatacagtgtcaatttccttgggataggctggaaaaggaaaaatagcaagtttaggagagagatgaataacctgtattagagtagcaattatatgtctgtttggcactgagaacctggcagaggttaagaatctgtgggattttcaaattgtgctaactacatgacaaactgccaaagcaaatctcaagtcagtgtaaacagggcagtttgtccttttatcaatgtacagatttctacaggactcacgagtgcagtggcgtgagctgactttacattgggcaaagagtatgcttcaagagtttcatgtgagacagccatgtcataaccagtcattatgtttctatgggaatttcatttacagaagccagcataaaatagaggtaggtctgggttgttcaagacaatatctaagcagtcttcttgtggctttgagaccattcctatagtcacaagtcaatcccatggaatggagtgggacctctccatcaccatggtggagtgttagaacagctggatttagagtgccacagcaatgtgagataatggaaggttggttaataggcctgttcatgggttgtttaccacaaggttaaaagttgctgtgttttatgaacttctaaaagagccaacacagcgtagagaaaacagaggagaatgaaggaaccaagtgtaagtgcaccagcttgtcaaggctacaagagtggctacagcatggaggcatgtgggcatgcctgataccacagggtctgattgatctgagaaataggctataggatgtttctgagagatgaaagtttttccttaaatacctatagtcatcccatttttttcatggcagtatatgtgaaaagatttgtccaaattgggtaagctgagtgctggggttgtagacaatgctgagtttgcaacttcaagagcagttaacgcttctgagggccaagaaatggattttgtggcaggatcctggaagatagcatatagaggtttagcaagggtagcaaaattagcagtctgttggttgcagtatccagctgcccctaaaaatgtacataactgtgtcttcatttggaggaaagagatggacaaaagactcaaggcatttggggataaattttgagtgtcttgaaatatctcaagtcctaaaagtaggtagcagtcatttgtattcactgaagttttgttctggaggcctgaagacttctttcagagagggccttttagaaaatgaggaactctataagagttacaaagtaagaagtcatccacatattaaacaagagcaaggcttttggtaaaggcttcagagtctatgctggctttaaggacctgcaaaaatattgaggggacctccaaatagcccaacttatgtgagtccatgttagttgtcttcctctaaatttatatgcaaaaagaaattacaagtctaaggcaataaaataaaaaaggaagctgagcgtaggtcaattactgtaaacttggctgcatcagctggaattgaagtaagaatagtaactggattagggacttcagaatagcatacaattactaaagggtttatggcccttagatcttgcacaaatagatttgattcagttctgaatacattctcccttccttcttttacaattggggtattgcagaatgaggaggcaaaaatataaacatcctgctgtaaaagggagtctattttaggttcaattcctcattttgcacctccatagaaagggtatcaggctgttgaatggaaggatttattcctttttcaggaaatgtgcacaggttctatacttagtagtagttcaaccttatttgcattcaaggtccaaagactaattgggaaaacttttaaggtgaagtccccttcagaggattttgattagagatgagtctccatcaagaaaagcaagaagtctgagtctttgtgtaaggccatggaagtaaacctaccacttcttattatatggggtgttgacatgaaatttgcacagctactttctacctataaggtttattggtgaggtatgagaaagtagaaaggcatagagagtgttaataaggccttaggatattgaggtgtgctgaggtgtcggtagtgaaacaggttgcccagagactctgatagcttaaacggaattagaggtgatggggagagagaaatcctctgagggaatagtagaaaagttgcactgtgtcaatttaaaaattgcattcttgatcctctgttttaattttaatgacgtgtctgggttgctactaaggattggctgaccatgtcaatcagtggggtttataaggaaattgtcttacagaagaggaaaaatggaccttctgagggtgctgaagcccaagaaaagtgcaatttaaactttccctctcttaatttcaggcatttatgcttccaatatcctggctttttattatctgcaaatatcttgagaagaataggagaggttctgtggttggaagcactttcaattattctcagccacatttttgtttttgtgagaacacagtttgcaaggcaaggactgctattttgcttctttctttttcttgctttcctacaagctattctcaaagaattgggtaaaagcctcaataataaagccgagaggttatcctgcccatctaaccacacttggttagatttgttcctttatattttggggaagatttcggactactgcagaaattcaaagatttctatgctttagacctctggatttgatacagtacttttggaaagcttgtataaagccttccacaaatggtttgggatgttagctttctttctgagtgcaaagtttaaccttagaacaatttacctgagggggaaaggcttctgtaataactgctatcaggccttgaatagcggtcctaagctgagcattttctggctctctgctggagtgcctggaaggggatctggccactggcttcccctgggaaggggttcacagaagccatctgtcttgggatataaatatagtattatcatgggcgggaagcaaactttttagtagccaactgaggtccctgtgtgtgggattagtgaatggccactaatctttctagctcctctctaaatacggtagatgatcttctggaaatagaggtaaaaacgttttgtaatttaaaagatatactacaatccagaggatataaattctttgcagtcagggtccaggatacattggcagagagcattgcctgggaaggcttggtatggatggagtttgattagagtcctgaaatgtaggtgtagttacaagggacggcaaaatcatccttgtggtgtgtacctggggcctctgccaaagtttctcctggctataagcatttgcataagtaacttgtttgtcccatgcctggaggtcaggcagcagtgctttgggtaattcttataaggaaatggaagttaaattggactgctgggtgtttaaaaaattttctagggaatttggaggagtattgtgaatgaaagaaatttgttgaaaaggctggggccaaaatttggggaggggatttatggcaggtttcagagatccaaaatatcttctggagtttcagagatagggagtcaggctggaaaggggaatttgtaatgggttatggattttaacttttgttccaagtctgatttttgtttttcgatttttgttgagggaatccctcagactagccaaaatgctttttttgtgttcttcctacaatctgatcttcccagaggtcctaataggacatttgtttagaatgagaactctcaaaacattgctttaaaatataaacgtttttccaaatcaaaagatccatcatctgttcatcaatgggtagaatcgtcaaggactgagccatcaaatgcagcacaaagaaaaaagcctttttctggaaagacctggaggcaactttctaggcataaagtgatttttttaccacagaggcaagatacatccctggagcaggtgcagaagatataacttccatgacgcagaatgtcactcccaaggataacaaaagaaattaaagacaattgttgccacagttggtaaggatgttgtttatgtgaaaactcccgtcactggtctttcatacaagtgagatgccgccaatcatagacctacttacctgtgataccaggcaggagatactggtatgggcagggacctttgatttagcaagctcccctgagtgttgccacagtcagacagataatattgcttgtgcaaccagacttccagcctgactcttaaccatcaggtgcaggcctgacagcttgtggtccctgtacaggtagaaaaatcagagacagctctctcactggattcaagacaagctccaagtacatgaaatggatttaaaaaaatctcctgcagttttattggtgtccacagcaaaatttatccaaatgaatagccatctagtaagaaccataaactctgtgaggccagctgaacaacaggctttggaaacccatttctgcattttgccctattgtggcaggccaggtctcactaacgcaggcctccataacaactgtctcagtactgaccgagtggtgaagttaatattaaaagctgatagagccagtgcccttacacaaaggctgaaatgtaacagaagcccaacaagagttttgcctgggtctttcttgggcattgaagcatgacaagataatgagagaattcttaacaggaccgtttaggattaaacaagttttattgggggtccaaagaaactccccaggcttccacaaacaagtttactgagggtctgaagaaactccccaaacctccatgatttagcaggagacaagataagggtaatcaccccagcacctggacctatttagattaagtaagcctactgaggctccagaggaaggtcttcaggactcagatctcagttatagattaaaagaagttaatcacttatgtctttggaatgcacacttacgtgtagacttatagcttagaaggtaagatgagctttggaaaactttgtgagtttgagttgatctggtgatattttccaggatttctccctgtaaccagttacagaaataaaaactctcttcttccctagttcatctgcatcttgttactgggcctcgagaaatagcagcccgaccctcagtttggttcaggaacactatgattccctgccttatgacaaaggacacaaaaggcaaaggcaacgtaaaatgatggctatcctggtggggaatggatcaacagcaaaggccaaatagaacaaaagtggcaatacctaaggaattaattcatacaaatgtttttaccttgttaatctaaattgaaaatttaaaaaggaacaagaaaagacagatcttacaaccctctctcagtcagatgctactgatggaaaatccaagaggcttactcaagaagaattcttacctttttcagtctttattaggtgccttagtcagtttgggtggctacaacagaatatcatagattgggtggcttaaaaaaacaaatattttcacaattccaagctggaaatctaacaagaaggtggcagcccagtcatgttcttggtgagggccctcttcctggtttacagatagccactttattgctttatcttcacgtggtggagagagaaagagaagccagcatttgtgtctctccttataagggcattaatcccattcatgagagtcctcccttcaaatgcaattacctcctgaagcttccacctcctaataccatgttaagatttaacgtatgactccgggatgagacatacaaacattcagttcatagcattaggaatcccaagatctcagctgcaggctctggaggaacaaggtgtcccagtctatgctgtctctttgtggtcactcgaaatggagcaaaataaaaactttcctctatcctcttaagatgtgcacctggggcttgtgaattagactgacaaaaggcatctaatgggaaaaaatacatgcaaattttatttgaaattaataatttattttttttatgtgcacagaggactttgtagaaagtgaagacccaaagaaacggttaaactcaggggacttgtatcccaacttaacaaagggtgattaattgtggagatgtcacaagataaaggaaaggagatttagctttgaggggcagtaaattgaaggaaggcaaatatatggggacactgataaatgataaagcctatctagtaaagttctgtttatgcagacccatctagtgtcatctccatctgcatcgatgaagattgtttttttcttttctattattataaagggaacacctacacaaaaggaaatttatgcacagcttttaggcagacagggggaaggcagagaagttttcctgcatctgccatctctcaattcacttctgctcagaataattcttatgtcaaaatggtaactggtggcgggatgggagggaggaggaattgggttccctttaattttacattgcaaatgtctgacaattatgggtagttttataattctaagcagaaaatacagtttggaaatttagtttcttttaataaagcagagaagaacaaataatatcaattaaatgagtatttttaaataacatttttaagaaatatttgtacatttaactttgatttctaccagtggaaataaaaagaatcctaaagattttaagcctcatgtctatagatgttttggtgtctgcttaatatagaatctgtcaataaaaccttcctaccattcaatatttttattctgctgcaaataaagctctcagggtcacaaaatatagtgagggcatgcaaatggctgttctgttttccttgaggaaaacccccacaatgcttttataaaaagttctgtaattatctaggttttctgtaatcattgaatataatttataagattaggagaaatacctaataatgtagatgatgggttgatggatgcagcaaaccaccatggcatgtgtatgcctatgtaacaaacctgcactttctgcacatgtatcccagaacttaaagtacacctatacaaaaaaaaaagataaagtatctctcttttaggtttatgggtgtgttttcttttctatatcatctccaagaaaccatctgtccagtcttattcatctgaggcatatttagtctctagctaaacaaaattgaaaatgttgctgggagttataaactattatgcagaagtgtgggaggttgtccttcactaacatacagagaatcatggcttaagcagtcccattgcctttatgtaaatattaaggatgacaagacagataatcctctcagactgaatttaatattctcaattcacttacaaatgagtggtatacactgtataaaacaaatatattcacaattatgaaaaataaatattagacctgaaaacctctagcacatagaaaatctttatccccaagttccactatgatcatcatataaatctttagatgccatttcaacttcacttttctagatcattttagataactatgtttctaaagcagaatacattactacttcctcatttccattaactgttttgcaagattttcaggttaaaatacaaaggcatgaactcggctcactgcagtctctgcctcccaggctcatgggatcttcccacctcagcccccctagtagctgagactgcaggcctgtgccaccatgcctggctattctccctatactcttaaagagatatatgtctaacattaacacattgtagagagaagaaattgaatttggattcagaaaagcaagattaaatcttagacaaataatgttagtgtgagtttttatttgcttgttttttaaccattcacgggcctcagtttgttttgagggatgaaatggataaggcaaggaaacttttaagatggaacccgactcttagtgtttcttttgactagtaaattgtacaccagataacatgtggacagtcttgtttaattgaaaaacctcaagacttagtgctttaaaaatatcaaagtgctatattctgacatgtccctattacttcactttaaaacatgtatttccttacaattagaacaatgatatctatttttaattaaaaaatagaaaaatagaaaaaaattataagcaaaatctcctacttctaactcatattcactgttcacatctggggacgtaatttttcaaaagagcatgtgtgtgtgtgtgtgtgtgtgtgcatgtgtgtaaaataatgcagtaaccacgattataacacaaagccgttctatacttttctttaatgatatttctattaaaagtatatatgaaacatgtctttcttttaaatatatcctaagtcatttattccatgggagtagcataatttctttatccagtgccctaaacataatcatttgatttaaaaaaaaaattattattacgaacaaggctttaatgaacaatttgcacatttagatgaaattattttcaagaattagaattctctaaaattttgtgaattagaattattctaattcataaagaattagagattttttatgaatatcaataataatagaaaaggcccatttctgtgcagaatggaataatatggatatttttcttctctttctaaactaatagaaaaatgccaataattacttttgtttaaatttcacttaagataccttgagattgagattatgaggttgagttatatttacatatttgtattgcctattttatgaaagaaaaagactactttgtaaaagcaaaattttctagtattcttgattgaatccatatatctagaactgccatggaggttaaggaaaatccctgaatacattcacattgcatcaaaggatcccagtagcatatttgaggagcgcatattgagtttgtgtaacaagggatgtggtacttttgttgactttttttatgtggctgtaataagtagaagtcaatgtgagggaaaggaagcattgaatattctgtattgaggttttagaaagttcacttttccatcagatgcttatatctagagaatttataaagtcaagattaaaaatgtctttcatgttgatacatgaagtacagattaaagaaaagttgtctctatattcatattaatagtttggggaagaagaaaactttaaaattgctacttttaaaaaagatcttagattttgccttaaaagcattcagtctttacattcctcaggctagatgatgtgtttctgcccaagggcagatgaatgtcactccctcagaaatccatcagtgccaggtctaaaatggccagaggagttgctgcaggcagggcaagcagaggttttcccatctatctcatgttgactttccagttctgtgggcccagggacttcgacaacttctgcattttgcgcagcccatgtggctgctgcttgtagctgccccacaataaatcagagaatggtaacagctttgcatgttacttcagaattttaaaaaccccacatagctccatctgtaacctaataatataaagtaatatatatggaagacaattatgtatttcaatcattaaattgtagcagtgagtagaccagactaatgaggatcatagaactatgctttctcaatttaagaacagcttaagtactgatgctgaaatttatgtgctttttcaaaatgtgtaaaaattagctccatttcacactgaaaccttctctgagactgctttctttgatttctaaaagacaaggtgcagactgtgcatgcggtaagtgtatactgtatactgtgcatagttagatccttgtaacttttcaaaaagaaaattaactgattgtttcaaggctgtgatgcaaattagaacattttctttaattattatcgttattattttatttatttatttattttgagacggagtctcgctctgttgcccaggctggagtgcagtggtgcaatctcagctcactgcaacctctgcctcctgggttcaagcaattctcctgcctcagcctcctgagtagctgggattgatggcgtgcgccaccatgcctggctaatttttatatttttagtagagatagggtttcaccttgctggccagggtggtctcgaactcctgaccttgtgatctgtctgccttggcctcccaaagtgctgggaatacaggtgtgagtcaccgtgtctggctattgttttgttttgttttttaaataaatgttccattcataataataggctaaaaagaactgttagaggagactgggcagatggagtggggcaggcaatttatcaacttaggaggtaatgtatctttccattctttacctgaagatgtaggtgaaacattttaaatcaaatagtaaaaataggatatgtttgctaccaatgctactaccaactacattattattgccaaaatcatcagataccctagaataatatataaatttatttttgtaattagataagacaggaagaagaagtaaacttcaaggtagaatgtctgaatatatactagaaaaattcccatagtttgacatttatcagatttcaagtaatctggggaaaagaccctcacaatatagtaggaaacatgttatgcacagttttacagaaatcagaatcataattggaaattggaatcacaatgattcagaagttgaataatttacttagagttaccctcaagagtcaaccaaaaaagatgaagaaagaaaaaggctaaaaataaattaatctggaataaaggcgtttgttgaagttgtttggcctaacactcaatgtattgctgcagcagataataatgtggcggttataatgaataactcttagaggaagaaaaatgaattcagagacacagttaggcatttaagactgataagaaaccacaaagactacctctcctgcaatctctgtgtctatgacaacttcaaatatagtatttcctatggcaaatttaaatgaaattatttttgataaaaactctaaagaccttttcatggtgacagatggtgttacaaagtcatgtatatctaatcagtaatctacacgatcttgtttcagttttgtgaggaaaaaatgaatgctttataaaaagagaatattttgcaattccaaataatagcataatttaatattaacataaaataattttataagaccagaaaatttcattttatatatattcaaaaatatgttttatcttcttgcaaatccagtattcttctgggatatgtaataagactttagggatgatttatgcaattcctctctactagacttgcaggtaggagtctatagtttcgtagttaaaaatatccactctgaatttatacttccttggttcaaatccaggctctatcacttactaagtggttatcattggctagatttttctgactacataaaatttttttatatcagtggcatttaatttcctttatgtgctttcttttcaaaatatgtattaaaacttttaatttgttacatttctttaagttttttttttattttaccttttgcggatgagctgaaagaacgttataatgatattccttaaagttatattagtcaaaacagattgatcaagtcctgaacggttctgctgttaacattgtccagaatatagccatgcctaattcatattttttaagttatttagtgccattccactttaccatatatacactattttatgtttaatgtactatttcattatattacatacttcaaagttagtaattttagtaaacgacataaaaccatatatcttaatgttacattatcaataaaatactttataatagtaattagtaccactgtcatgcctattattactacattacttccactgagacactgactagcccatatttgctgaatgttgcccatgtcatcagtaccgtttgtaagtgctttatatttcttaactattttaattatattaatgacacaggacactttcagtgccgctttgccagccagaaacttctgtggctggtggcccctctgcccgggtttcactccagcccgctcaacctggcaggctgcactcgactcgctccctggcctggatcccgtgaccaccatggctgtgtggtcaccatggtccagcccatggcaggaccagaagtgccacaaggggcttccatgtctgggagccagcattcagacaaggggagcgctgtggcaccccaaaactcggagacaacagtgaccacggaactccaaagaggtgtcacagattctgctcggggagttctgaggtgtgggcccccaggaagtgttacagttctctctcattcccgccatttacagccgagcgaacgagggcgtgtcacaactcattcggtcccgctgcctagatgggcgagccaaccagaagcgtgctgctgcccttttcactgccactatgcggcaggttccaggttcttgttctgtgaccagaagaatgaggtacgtggacaccggtaagagagcaagacagagaagaatttcattgagtgacagaaaagctctccacaatgagaggggacccgaagtgggtacccctctgtgtgagaaggaggcccaaagcagataaatgtctgaaaggctgagtccagggtttttataggtttgcaatgaggaggtgtgtgctgtaaggtagccttggaaaaggcaacatttgattggttaaaaagcttcatccagaaggaatcaatagagagagagtggacaaaccggaatagaagttctcactctggtccagaagcttggttttcaggcaaaacggtctttggcttggtcaggttttaccagggacgccctcctatctgcttaggaatttgactgtctcctgctgctattaataacaccatgaaactcgtttttcttttaaaaatggagtctcagaggttcaggaaagtgaaatatctttcctaatcacaaatcttcatgcgttagaaccagaatatgaaatctgatatttccacttcaaagtatactttatccatgactcctgaaatgcctccctgacagaaaagccttacaaacgaggctaataatccaaatgaattttgttttccttttttgcttttctcttctttaatttaaatattttgccacaattttttgaaagtgcttcctttaatattttattttttttactttgctattatatttattttttcttcttaggggcctattttaatagctcacctaaacagctaaaagaataataaaaaattttattccacatgtaattaaatactttcatattaaaaaataaatgtaccacatatactgaacatctagataattgcttatacattttatttttcttccaaatttttttttcttgatttgaaatgagacctgaaaatacttggtcctattttctaaattattgtgaaaacttaaaggtagccttcaatatctcttcctaagattttaaatctttaatagaaaacatatgaaattaaattttggagctatctgctaaacattgtctttaaaatattttcagttttctattcattgttcaaggatggaaagtagatcttatgattctaaactaaaacccacaatttatgaaatgtcttgcatgaattagctcccatatgttggaagtgttgagaaatacattgcaaattttaaagtcacctacaaaactttaaggacagaaaagtaaatctagtcctctccctaactttttcctgggccacatgctcaccattccagacaaatgagaatctatccatgactaaaaaaaatctccagagaagatttcttaacgtaccctaaaatgttttcactctcgcttttagtagaatctccttattgctcgctttattactgctagttaagtctgcatcggttgctctcctctctgtggaaatgaagaacagctggcagatatcttctgtgtaaaggcatttgaaattctagaataaagtaattaaaacactttctttgcctttgactaacattttccaggatttatttgaaacttttataagtttttaaaggttttacgtgcttcccgagtcctggaatacttgttttttctgaagctgtataagatattgcctgagcagaaaagagtaatagatggttgtatatgattctaatatatcattatcttatttctttaaatattatggctgggtgtggtggctcacacctgtaattccagcactttgggaggctgaggcaggaggattgcttgagcccaggcgttcaggaccagcttgggcaatatagtgcgaacctgtctctacaaaaaaaaaaaaaaaaaattagctggtcatggtgacacacacctgcagtcccagatacttgggaagctgagttgtgaggattgcttgagcctgggagatcaagggtgcagtgaactatgatcacaccactccactccagcctgtgtgactaagcaaaacttgtctcataaataataataataaaaacaaacaaacaaataaataaacattgctatcagaggtatgagtcatttatgtaaatactcacatatttcttctgcaggtctgaataggggaaataaaataccaagaagtattacttcataacttttgtaccaacttcagttactaaataattttgtttggggaatcttataaattcctccatgagcctggaataccttgacagagattatttccctcaataaccaataatcagtcattaatagagcctcagaatcttcaagcccggtcataaccattatttgtagaagtgttattagcactgatttctgacataaactctaattaaatcttgaatttgtttggacagtgatcataagacaagaaatatataaacaaaaaatgaaaccatgaaaatagaagcatttatagaagctgcactacagcatctaatcaggagggtgagctgatttttttttcccctcaaacatattcaaggacagaggtcagcaaacattttctggaaaacagtaggtagcagatatttttggcttggcatgccatatggtttctactgcagccagtcaactgcagcactgtagcattaaagcagccacagccaaaatgtaagcaaatgcatgtttctgtgttccaataaaactttattacaaacacatgcagcaggctggatgttgcctgtgggccataatttcccagtccctgttctagaataaggagtgccaagacctgccaatatgtgctgaacttcctgctttcccacattctctgaaatttttccactgctgggattctccgagggactaattttcctcaagaagataattaaattccaaatcagaaagatgccatgtttcctctatgtgctgtgcttcggcatcaacagcaggcattttccttgtgctgcctggctaatgtgtatcataatctcccatctcagcatcagatcctctgccggtttcctcctggtagacttctcatttttcaaaatcaggagctaaaactaaactttcccacaaatcttccaagagactagcatgctggtcctaaattctgtctccagtgattggccatccaaacgctcctatcacatctcgcttctcaattgctcagccccaaaacaccagagtcacttttcactctttccctttacgtccaattcatcagggaattgttaatagtgcttgagaatacatgcatgcctcactatcctttactacctaatagtttgagtcatcattatctcttctctgaattattaaatctaccatatcacccaatctattttcaatggagcaattaggtaattttaaagcataaatataatgtcaaaattctcccaggagtcctcagatcagagtaaaaaagtcaaggtcctgccaatggtatacatgaccctgctgtatgtgatctgtgccacctcccaacccttatctctctagccttctatcactctcacctaatctctgggatccagcacatcagcctcctttgctgttttttgaccacaccgagagcacttccacatcagagcattccacagccttatttttttctgcactggatgtgccccatcacctcaatttcaccaatgttcgcacctctttgtcttctttagtataattccacattctttgagtcctaacttggtcaatcatatatcattgcacccagtcctccctcgtctctcaaaatcccacctaccctgccttactttttcttttcctcatatcgatcatcttccgcaatactataaaatttaaaattgtttttatgttgcatttattgccattgactttctttagctgctaaattacaaactcctaagagtgaatatgcatctactttattcacagatttttttccaagcatcagtgacagtgctggactacacagtggaggaacctcgaaaacattttgctaagtaaaagaagctggacaaaaaatggtcacatgctgtgtgattccatttatataaaatatccagcataggggaaatctataaagatagaaaattgatgcttgacaggggctggggaaacggagattgtggaataaatgcttgatacgcatgggatttctagagaggtggtgattgtacaacattgtgaatctacagaatgtcactgaatggttcactttaaaatggttaattttatgttatgtgaattccccctccatttttgaaaattacaagaaataaatttttatgtaatgccttcacctgtagagacacttattagcaaaagttcacatgctttgggaatagagtggatgtaatctgaagctagggattgctagagaggcagtgcatgtgacaatcacatggcgttgaataactgaaaggactcacggggctccaagttatgccctaaatgacactttaccttcatcattgccctccgttcacaaatgcatacatgatttataagcattggggcacatgattttataaggagttgtaaaagcaggagatagtctaaccactatgtatggacacctttttgaaaagggcatttattagtttaaaagttacatattttccacgtccctgctattgaacaaagtcctctgttttgggaagcaacacatcctacttactccctaagaatgcaccctgtgtaatagataaaacctgcaaaatggaaaccaaaagagagggtgacattagaatcattgtaattgttcatccggtatcatcaagatatatcagaaacgttgattactctgaattgaatatttcttaaatcttcgccataccaatttagaccattaactttagacaagggagaatggtctgctaggtttgcatttattgacatttatttatttatttatttttgagacagagtctctcactctgttgcccagactggagtgcagtggcacgatctcagctcactgcaacctccgcctccggtgttcaagcgattctcctgtctcagtctcccaagtagctgggattgcaggtgcccatcaccgtgtctggttaactttttgtatttttagtagagatgaggtttcaccatgttggcctggctggtcttcaactcctgacctcaaatgatccaccagcctcaaccttccaacgtgctgggattacaggcatgagccactgtgcccggcctgacatctcttaatatagtgactactattatttattctctatgatgttatgaagattaccactttttatcttgtctgttgagattttcttttccttctccattcaatatacaaccttgaacagttgcaatacagctgccttcagtttgaatttcagccctctattccttactaccctctgtaaaccatgccactctgtcatattctggtaaacagttataaaaagtggtgccttcagatattaattagataaataaccaggaaggcctaatgtagagctcaaaggctaagagcttcttctttaattacgatagttgtcctcaaaggtgccctgacatagattgttgtacataccctttctattttaggatgcatttcccttccttacagaatgttgttctgatataacccatgacattatggagttttcaggtgttaaaataattttatgtctttatgtaacattaacaatttcaactgaagttcaataataggctagcaattgtcttttaaaaagttatgcctggaggtaaacccagataatttctaatcccaaatccccacaatagccaatggttggcaatcatgggcttttgccaaaggcttctgtttgtgtgtgagttgctgacacaatgtcatttgaacatcacggtagcgttgtcccaaaggaatctatggtgtgttagttctttgaggcttcaagagagcctgcagttgtccagaacatcaagaaaattcagtttttttcctcatatctttgtaaatcagggttactgaaatttccagatgtgacagacgatatcttcacaaatcaaacaatacattcaaactttatcctccttgttttgatttcaagaaaataacctatttttaattgcttgaggaataagtaattctcttcattttaacatttatttggtacaggtacttcctttggtcatatgattaattggcactagagattctgttttagcttaatattcagattgagatatgagtattatataataaagatagcaaattatacttctaacctggataaaacttaagtctcatctcaccaggttgcagaaataagcaaaaaaatttaaatatgcttgagaaagcacagtaaataaatactggagtccatcacacatgaattcaaattggctttgattttcttgcaagatagaaattaagaagaaaatgttagtccaattcatcacagaataccaatctcctttatcttgttgcccaggttttgctttttttgtttgttttttttttttttttttttttgttgttgttttttgacaaagtctcgctgtgttgcccaggctggagtgtagtggcatcttggctcactgcaacctccaactccaagattcaagcgattctcctccctcagcctcccaagtagctgggactacaggtacccgtcaccacacccagctaatttttgtattttttttttttttttttttttagtagagaccggctttcactatgtaggtctggctggtcttgacctcctgacctagtgatccacccacttcggcctcccaaagtgctgggattaccgacatgagtcactgcacattgctgaattgttaatactgtattgaacccagctgatacttttgtaggtacaaatgtatttaatcctttgtagtctagagttagacttgaggatctataagtttttcctagaggtctcctttctgacaaaccacaaaagaagggatttgtggctattattataattgcatttaacatgcttttaaagttaagacaaaaattcttgatagtctgtctctgggtattttgtattgttttaaaaattaccatgtgagtgcttataaatagacctaaaggttccacctaaaatacccagttaaaacaagacaaagataatattttcacctgtaaacccatatccatcacacttcatacagacatcacatttatctcagtaatatatttgtgtatgggtatgtgtaagagtccattcttatattgctatagagaaataactgaggctgggtaatttataaagaaagaggtttaattggctcatgattctgcaggctgtacaagcatggcgccagcattgctgggcttctggggaggcctcaaggagtttttctcatggtcgaaggcaaaataggagcagtcactagacatggcaaaagcgggagcaagagagcgatgttgggggcggcgtgctacacaccttttttttttttttttttgagactgagtcttgctctgtcgcccaggctggagtgcagtggtacaatctcggctcactgcaacttccacctccccggttcaagcaattcccctgcctcagtctcctgagtagctgggattacagtcacacgtcaacatgcctggcaaatttttttgtatttttagtagaagtggggtttcaccatgttggcctgactggtctcgaactcctgacctcaagcaatccgccagcctcagcctcccaaagtgctgggattacaggtgtgagtcaccgtgccctgtcgctacacacttttaaatgaccaaagctcatgagaactatcttttttatttttttgttttttttttgtttgtttgttagtttcaaagagtggagagtttaataagcaagaaagaataaagaagctcccccatacagagacagagggagggggtctccaaagctgagagaggaaatcctgagtgcaaggaaatcagccagttatatgaggaggctggaggaggcggtgtctgatttgcacagggctcaggggattggtttgaccaggcatgttactcatgtagcttgtgaaaaaaaatggccctcccaccctagccttttaatatgcaaatacagggcaccatgatgttctacacacgtggggatatgtacaagcagccatgtttccaggcacatgttggggcaaggaagaagacggaggaatcgccatgtttgggtggacccagtttctcatggcctgcatttgcatatcaaaacttgccacctggctctaaaaactggggctttcctgctagacaagaaatgtttctggagctgctttaaaagaaacaaaaacttcccaaggaccccttttcctctctatctacctaaaataatttgtagtaactcctataatattcctcctgtggagatgtcaccttaactgctgttagggggttttggacaacaactctttctggctacttcctgctgaaaaggggcgttgaatggggaacagcagctagggctccctctgggctggatctaagagtcctcagaagaatggtgtgtccatgggtgattcagtttgcagcacggcttggagtttgattgcttctaggtgagaggaaacaatttgagttatagtactgagtatacagtgtccaaatactaacacaagacataagctctctgtccaatatttcacttaggaggtgctaccatgtataataaccctgttgcaaatagtagagtgagtatagcaattcccacaagtgtggtgtagtagataatttccatctaaaattttacttgccaagatatagaacttcgctttggggtgtctatgaagtttcttggtttcattttcccaaacaaataaacctccaggttatgggcaccctactcattttcattacctggcagaatttgcaggataagtgcccagaactaacatattgatccagatttttacattacccatccctttttgattcttccaagctgcaggagctcaccacttgcttcacaggaataggcggggttcatctaaaacgtaggcaaaaagcttaaaaacagttaatgagactaggatttaatgacaaaagtatgataagctttggagcacaattcctttctccagtccttatttttttggtaagaataaattatgataggaccgtgtgtattatttgtagaataaactttattgttatacttggcctgattatttgcataaaatgcagcaagaatggttatttctacataggccttttcaattggcttggatggaactctgttccacaaggaatttcagataagacctttaaagctgagcccagggctgggcacggtggctcacgcctgtaatcctagcactttgggaaaaaaaaaaaaaaaaaaatagtcgtgcccggccatgtgtttgtatcctcaaatacttgtgagttgggagattctttgcttgtaaggtcccaggataaacttggagctcccagacctgttagaaagtgacattccttactgaccacaggttaggaactctgtgcagggatggcgtagacaaggtatgaggccagataactcactctcttgagtacagtaccaagtgggatggcgctaaaccattcatgagaattcctccgcccccatgatccaatcgtctcccaccagaccccacctccaacactggagattacatttcattatgagatttgagcaaggacacacatccaaactatatcagtatataaaaaccattataacttttatttattagctcctattttgaagcatagttttactgtttattttgctgtttattccttctacagttatattatcatctgatccacttaacaattatattgcctttacctttcaataaacaggtttgtgtgtggtattacattgtacaccagtgtccagtaatacccataaaattcctccactatgtcaaaggcattttacttatagaacaaacaatttccgatccctttcttggggttgtgccaagagaatgtgtacaatcctataatcagaatcagaatccacttttaacctcatattgtattaattggcactggttatagaggatctatagatagctctcttgcatcatcctcctaagattttttttttttttttggtaaattcattagggctgggataaattgaataaatttgtcacaatcctttactatctgaggagttggtagaacaatcacaccacctaatctcttatattaaaacactaccattttaatggtaaccactttcttttttgccatttttaattaatcatctgaatacttacacatagcttaatttattcaaacgttttccccattggtttaattcttacgttttgtgtatagaacatctccacatcagcctgtcttgtgaataacaggggcttataaggagcgtgagaagttggggggagaccctccttttgtagcagttatcacttgggccaaaagcataacatttggagataatttattattttttataaccaatctaaagttgtgaatattctcaagattctactctatttaacgtctatggatggaattagataaattcctttatccagttacgttctatgcacttctactttccaatagctgtgcagatttggagttttgatgttcatacccatttctgtaagggttgaagataattaagaaactgaataagacccaccatgctcagcagtctttgattgctagggaaatagatctctctgtcacgaatgcataaatacatttgcataaatgcataaagtacatttcagtagtgactcaccaggaaactgttgatgtcagcccacaaagtgacttaactctttgactgattaatcctgtgttcagattgtctcttttttcccttcccctatgaactgcatagtctctagtgtgatcatgagtcagatgaggttgttttctgatcaaagaaaatatcttcttaactatcaaaaaccatctgactaaacttggaaaaggattttgtagcccaaattgaaccttgagatgactgtattccaggctgacagctaaactgaaatattttgagagattctgacaccgaaccatctggctgagttgctcccagtttcatgaccctcagaaaccatacaatactaaatgtttattattcaagctgctaagttttaagtgatttgttatgatagaagagataactaatgtagtaccaagtgcttggttcacttccaatctctctgaaattttaaaaattcatttggaaataaaaatgaaattataactactcataatttgtgggttgcagtggaagccgtgcttgagggaaatatatggcattgaatgtgtatattagataagaagagagatctaaaatcaataccataaatttccaacttaggacactagtataagaagaacaaattaagtctcaataaacagaaggaaagaaataataaaaattagaacagaaatcaatgtaattaaaaacaaggcacaaagataatcaataaaatcccaaactggatctttgagaagatcaataacattaaaaaatatctagtaagtctaaccaagaaaatttttaaaaacacaaattattaatattagaaatgaaagaggggctgttacaactcatcctgagacattaaaaactatttaataaagaagtattatgaacaactctatgcccatatagtggataaaattagcacacaaaaaagaaatattttggtataaatctaacaaagtatgttaaacatctacactaggaaaactataaaactttgataaaaaatttttcaaaagacctaaatacgtgaagtggtattccatgttcattaagagggagacttgatctgtaaactcagtgcaataccaacaaaatcatacgttttcttgtggatatcaaccaactgattctgaagttaaaatagaaaagcaaaagacctcaaatagccaacacaatactgaaagggaaaacaaagttggagggctgactttacctgaattccagccttattataaagctatagtaattaaaacagtatggtattggtaaaataaatagagaaaagactcaaagaaccaggagctcagaaaacagactcagtaatagaatcaaataatttttgacaaaggtgatacatttttgatatatctaataaatgatttctataaaaaatatacaaagaactcttaaaacatgataatcagaaaataaacaacacaactaaaaatgggtaaaagttctgacgagaaactttacttaaaattttatacttggaaaataagcatatgcataggtattcaacattatatgtcattagagaattgcaagtcaaaacaaacacaatgtgaaactaaaacacatctattagaatggcttaaatccaaaacgctgacaaataccaaatgctggcgaacatgcggagcaattctcattcattgctggtgtgaatgcaaaatgtatttaccaaataatagaaatacaagtcaattgaacagattagagaacccagaaacaaactcacaaattgagtcaactaagttttgacaaagatgtgagcgtcattcaatgaagaaagtttattattttcaagaatagtgccaggaaaattagatattcataagcaaaaagaaagagtaaaatttgatttatacctcacaagatatacagaatttaactcaaaatagacaaaacacctgcatagataatccaaaattctgaaagttctacaaataaatattctgagatattgagttaggcaaagaatagcttagctataataccaagaggatgatccacagtagaaaaatattgagagaagagcataagtaacacaggtgtcaaaaccaacaagcagagaattttaaataggggtcattaagatgttaacatcaccaatggaaaaggtacaaaacatgcatgtttattttgagtaatctaaatatctatgttgagagaaaatatttgtgaactaaaaaatgtgtttataatcaaactatttgttgagattaaaggaatgaggataaaataagaacatttcagaatgacaaaaacttagagtttaccagccattaacctcctagttctgaaggacacacttcatgaacaaggaggaggaggaagcgaaagagagcaacagcaacaacaaaggaccctgcgtgaaaaatctgtgatacaagaggaaagataaacaagggaacaagaaaagctgtaaattaatgtaaatacattgtctctgtaataatgtctagtttgtgaattttttaaaaagactaaaattgagaacatcaactgcatgtaagtccaggaaatatgagggagactgaaatcctctaaaggatgtgtatatttggccaggcgcagtggctcacacctgtaatcccagaactttgggagaccgaggcaggcagatcgtttgaggtcaggagttggagaccagcctggccaacatgatgaaaccttgtctctactaaatatacaaaaaaattagtcaggcatggtggtctgcacctgtagttccagctacttgggaggctgaggcaggagaattgcttgaacccgggaggcggaggttgcagtgagccaagatgacgccactgtactccagcctgggcaacaaagcaagatgctgtttcaaaaaaaaagaaaaagaaaaagaaaaagtgtatattttggtaatcttttcaagaaaacaactgagacattgattttcattagacttttctaatgtgttataaattatgttaattttaaataaaaatagttaacagaataaaagaaatataagtttcaaaagattaggtgaagaaaattgtagtgagaaataaaaaataattcctagaaacacaaatgtttaaaatttaaaaacaaaatattgaaacgggacaaatataaaacacaaaattggcctaagtatattaataatcaaaataagtgtttttgaactaaatacactattgaaaatattgacaacttagataggtttattttttaatactaccatattctgcttaaaaggatgtttgtaaagaatgaaaataaaaggcggaaaatgacaattaaaaaattcagagtagatatatctatatctgaccatgtagactttaagccacatccaagattattaatgtcagatatatttaactgtctaagaaattgtgacaatttcaaacatccatataaaaaataaaatgatcataaaagactgaaaacaaaattgttagaagtacaagtggaattgacaaacacattaacgtaagagagattttttaacagattccactagtcaataagaaaaaaataaaattacagtgtctgaacacaaaattaacaacctaattgaaaggagacacacacaacctgaacttaataatttaggtaacatatttttttggaacacataaaaaatatttaccaataagaactatgttcataccctccccccaccccacccccaaaaaagaagcaagcctcagcttcaattcaggaaatattaagaactagcaaaagacaaacctcagaaaaaatgtgaaactaacatagaacttgagaaatgcctttggaagtccaagtttcttttgaacttaaaagacttcatagaagcaacagaggatggaagttagctgtgtctgatcttgcttttcccatagttgccttgagaaaatcgcctcccccaagcatcacagaaatgagaaagtggcactttgtgagatataatagatttttgtctttttatggctacccagaatctttttaatgcctttcctataatttgaaatttctacctgttctgaattctgcctacctaaaatagggaagccaggatgcaatgcctcaatttcatttgcagctctaatgttttaataatctaggcttctttagttagatatgtatttaggataatttgttttagaatagataaaatgaaagaggcaacaagaagcagacctgtcttgttttaggtgtttgcctgtgtgagagaaatcaaatccacattttcagggttcccagagatagattcctttgcccactataatcagtagaatataagtatgtaagtttaacaggcagcattacaagatggcccaaaaaacctgccctccactgtgtaccactcatgtaatttccctctctgtgtgtgggcagagcctgtgactatgatagggcatcactcctgtgatgagttgatttgaatgaaccaaaagagcatcctggcccaattaggtgagcccttaaaagggaagttgaagagattcaatgtgtgagaatgtgtttggaagaacatacatggcaagaaactgtgggtggcttctgggagcctaaagtgacacctagacttcagccaggaagaaaacagaggcctcagtgccacaatcataaggaactaaactctatcaaaagcacacgtatttgaaagagtgcccctagctccagaaagaatcatagccaagtcaatactgtgatttcaatctgaaaagagtacccaataatctgttctctctcttgtttttctcccttgtagaccttcaggcttggacacctatagaagttcatgtaaggctaggaagtttacacaccctggtttctctgtggggcagaccgtggtagacataacagtggaatcagaaagagcaataaagaagctatatctcaagtctaggaaaagtaggtcatttgaatgaggttggcagtagtgaagtaggtgaggcatcacccgatttcaaatttattttgaggatagaactgacagagcttgctcatggataatagagaggaattaggaaagacacttagctttttggcttgtgtaattaactgaatagtggccctcatctgcagttgtgaggagatttgggaaggagtagatctgtagaagaaaccaataattctgtttgtgtcgtgttaagttaaagatgtctattaggcattcacttaaagatgtcaagtaggtaaatggagttaaaatctatttagaagagaagtcagactggataaatagaatcaggtgccagtatagaaatggtatttaaacccagtggactgggaaaaatgtctttttttttttttgtatgtaacaaaaggactttgcaggcaatgcctactggaaatgtataactgtgtgtcaaaacaccaagctgaacctgaatatgtaaatactgtttaaacttttaaaagaatatatacattgtagccaggtgcagtggctcacacctgtaatctcagcactttgggaggccgaggagggtggatcacctgaggtcaggagttcgagaccagcctgaccagcatagtgaaaccccatctctactaaaaaaatacaaaaaatagctgtgcttagtggtgggaacccgggaggcagaggttgccgtgagccgagatcgcaccattgcactccaacctgggcgacagagcaagactccttctcaaaaaaagaatatatactttgtatatcagcattatcattaccataatattaactgatgatcttggctactttcaatgtaggagtttgcatgactaaactctagtaacaataataataaaaataaaaataatgatgccagagagttaactaggcacaaagcaaaaggagacaccaataggtctagtaaacataggaaaaaatatttcatttcattagccatcaagcaaataagacataaaagcacaatgttacacaacttcacactaaccactatgtaaatgatagatgttaccaagcgttgtatagattggggagtaataacgtcttttgtacaaggctggtagttctgttcgctggtagttctgttcactggtagaatcattttgaaaagcagttttgcagtttctcataaagcaaacatatgtctactatgtgactcaaaaattcctcttctgggtatacactcgaaagaaatgtgtgtatatttttactaaagtcatgtaaaaaatgctcatagcagggctatttactgtggccctaaagtggaaattacgcaaatgcctttcagctgaaagggtaagtaaattgtggcatattcacaatatggtctacaatgcagtgataataatcaactgtaattatacataataatattaacacagttgaatctcttatacataatgctgagcaaagaaagccagacaaaagagttaaagtactgtatgatttcattcatatcaaaaagttcaaaaatgagcaaagaagtgagaagaaataaataagaagttagaatagaagtcattcttggaaggtgtagtacctagaaataggtagaaattcgtttctgggaagtttgtagtgttcaattgtgaatgtatactgagacctgtacatgttttatttgtgtacttctcttttttcacacttatttatgtattatattcttcaaaacaaaatcaaataatttacatttattttgtgctttttatgtgccaagttacggcttctcaatctaggtacaatttctgcatttataacacagttctgcaaggagaacattgatattttagtgaatgaatcatgattttttaaagaaaaacatgtctactaattttataaaaatataactgaaaaggttaacattaacatttattgttgtatataattatttaaaagcacatgaaggtcagacatggtggttcactcttgtaatcccagcactttgggaggctgagccaggtagatcatttgaggccagaagtttgagaccagcctggccaacatggcaaaactctgtctctactaaaaatacaaaaattagccaggcctgtagtgttgcatgcctgtagtcccagctaatcaggaggctgagacaagagaatcgttttaatctgggaggcagaagcagtgagctgagattgcaccactgcactccagcctaggtgacagagtgagactctgtctcaaaacaaaaaaacaaacaaaacaaaccacaacaaaaacaacaacaaaaaacaagtacatgaaagcaataaaaaacttcaatataactaaatgcttttgttattaatatgaacctatttcctaccattgtttaactaaagattttagcctcattttaaaagaacatacatttttagactttgtaacttgatttcaaacacttactataagtattcctggttccaaaacctctagaatctagtaaaaactgtattaagagcttttattggaagattcgtgtcatctttatttatgtgcttagaaaaatttgaaaatataaactaatcagaaaagaggtacttatttgcacatgagagtaagttttaaacactacttctatgcctatatattgggggaggggagaaagataattgttagtagtcagtgttctccagagaaacagagccaatagaatacatgtatatgatgggatacattgtaggaattagcttatataattagattgagaagtctcacgatatttggcctgcaaactggagaaccaggaaagccgattgtgtgattcagttagagtccaaaggtctgagagtcagggggccagtgatgcaactttcagtcccaagctaaaggcctgagtaggaggatggtggggcgggcagcggcgaggaaggtgttcttcttggtccccagagcccaaagacccaatatatgggagcactggcagtgatattcaagactaggagaagatggatctcccagctcaagaagagggagtgaattcaccctttctctaatattttgttctattgggcccctaatgaattgggtgatacccacccatatccatgagaatgaatcgtctctactcagtctcctgattcaaatactaacctcttccagacatactctcaagaacacatgcaaaaataatgttttaccaagtatttgggaatccctcaacctagttaaacagacacataaaattaatcctcacaataattaaagaatattcttgaacattaatagtaaagatttgttattttcttgttatctacttccctctactatcaacccaccccatttacaggagaattttctaatcttttgtctgtcttctctgtggtgtatagtaaaagttcactcataattgaaaatacagtctatgcaagagatctttctgtgaaaataaagatatgcatgaaggccttactagagattaattggccatgtaattatttccactcaattgaaatgcctataaatttgaattactgcctggcactgtggctcatgcctgtaatcctagcactttgggagaccaaggtgggctgatcacttgaggtcaggagtttgagaccagcctggccaacatggtgaaagcttgtctctaataaaaatacaaaaattagtgggaaatcacttgaaccagggaggctgaggatgcagtgagctgagattgtgccactgcactccagcctaggcaacagagtgagactccacctcaaaaaaataaaaataaaaaatgaattacccaatgtacaataacagacagtgtttctttttttttcttggttccaaagcaatttttatatatctgatattatattttcctgggatttttcgataatttatattttgtttttcccaaacaattgatggcaagcttcttaagtgtggaaaatacttttcattcataatgataacttctaggtccaacttatctttttcttctgtgtacttttcaatactgattaataaagaaataggataaacatgccacagtctaactgaaccacttgaaataaattacatattccagaaaagatacattttgggtatatttgtatttctaaatatttgtattactaaataattttccaccaaatatccctttttagaaatggactttcatttttagagcagttttagtttcaccgcaaaattgagcagaaggtccagaaatttcccatgtgcctcctccccgcaacaggtacatagcttcttccattaccaacatccccccagagtggtatgcttgttgcaatcagtgaaacttcactgatacattattactacccaagctctattgtttgttagggcttactcttggtgttgtatattctgtgggcttaaccaaatgcataatggtggcatgtatccactattacagtattagacagaacactcactttcctaaaaatcctctttgctcttttgctcttcctattcatccctccctccccgctaagtccctgaaaccactttttttttcactctctccttagttttaccttttccagaatatcatgtagttggaatcataaagtatgtagcctttgcagattggcttcttttacttggtaatatgcatttaagtttcctccatgtttgttcatggcttgacatttatttttagtgctgagtaatatcccattgtctgggtgaactgcaacttacttatctactcacctgctgaaagacatcttgatttcgtcccagttttggcaattgtagataaagctattctgagcatctatgtgcagcttttctcaattcccttgagtaaataccaaggcacacattgctggattgccaagtatctcttttgttattttctctttaggcaaaaactgtctcggtgattcttatttcacaacaggcttaatttattataataatgttatttttagttttatattgataaaagcaatacagaaataaacataatgtaaaaaccatgagaagtaataacataattttaaaaaatatttgaattgcatattataacctgtactgatacatacaaatctaagaaccaaaagcagttatccaattatctagaacagtggctaaccaaagtcattctattgcattcacagtttgattttctacaagttgagaatgataaaggcttattattaacaccaggttgaaatggaataattgcaattactactagaaaattaatatacctattttagctattagaaaaaaattatcaattgcaaaatgaaaaatctaatagttcaagtattatgaatataaaaaatataaattagttgtgattgtgtaatgtaagaaactttatttggttatactccacaaaataaataaatatttgagaataaaacaaaattaaattgaaatcacagacaattttcttttgctactcgccacaaataatataactaagctatgggccactgaataaatagcagcaaagcacagcaatcactagaaggaaacaaacatttgaacttgaaataaaggaagatttgcatatgtgcctggcaaaagaatctattgattaaaacaaattacatctccattttttaagttgagtttatgtctagaataaatagagaatgatccatagcaagcaggaaatctcacagagttgcagagcagcaatataaatactacattactcaaaattaattttcaactataaacttttcaaaagccagcacacatataataaaaaaatgaatttgaatgaatggtagtaggattgagacaaaaaaaggaagaatgaggaaatgagagatagagctagaaggtagaaaaagagaaagatatttctaaatgcaatagcataccctttattgttagtctatataaaggcatatgatggattatatgtaatataaatttcctttgacatttagattccttcaatacagtgccactgaaattttaagtttaaaattaatctagagagttacagtaagatcagagtcttgcttcattgatacataacacttctgtttattagttgttttaagaactacacattagcagctttgttgtgtcaggagataaatataataacatcacagatgatgaaatttatcaatctgcagaaaatgatttcggactcagtaaaggacacagagaagaatctatgtatttatatattgtctgtttgtctatctatctatctatctatcatctatctatctataattgttactatgggagcacacttaaggagcaaaaaaggagagtttaaagttggccaaagacaggtatgggaaagtaggttgatgctttgagaagggaggtcctggtacagatggataagaagtaattatgaagagtgaattttagaagaaaaagctaaatgtgggcaatgacagaagacagaaaacaaagtctaggtcaaaggttattcaatgtggcctgtaatcccagcactttgggaggctgaggtgggtgaatcatgaggtcaagagatggagaccatcctggccaacatggtgaaaccctgtctctaataaaaatacaaaaattagccgatcatggcggtgggcacctgtagtcccaggtacttgggaggctgaggtaggagaatcacttgaaccctggaagtggaggttgcagtgagctgagattgtgccactgtactctagcctggtgacagagcaagacttcgtcacaaaaaaaaaaaaaatgtattccatgtgaataccaatttagagctccattacagattactgaatgttatccttatgattttggccttaattctgtgataaataacacatttttagaaaatataagtaggagaatggaataatgagagttgtactttagaaaaaatagttcttgggtgctgcattgtttaaagctccaagaattaacaagtgtcaagatccagttgaatgtttgttgcttacttatttttttttagaatttctgagacatatcaccaagaaaatactaacttgaactatactactctttctctctcaagaattgatctaagatacagttaaatacagttcacccttaacaacatggcttcgaactgcttgggtcaacttatatgtagatttttctctgcctttgctatccctgagacagaaagaccaacccctccttttcctccaactcctcagcctgctcaatgtgaagatgacaaggaggaagatctatgtgatgatccacttatacataatcaataataaatatatatttttttcttacgatttttttttttttttttgaggcagtctggctctgtcacccaggctggagtgcaatggcatgatctcagctcactgcaacctccacctctcaggttcgggttcaagcgattctcatgcttcagccacccgagtacctgggattataggcatgtgccatcacacccaactaatttttgtatttttagtagagacggggtttcaccatgttggtcaggctggtctcgaatgcctgacctcaagttatttgcctgcctcagccgcccaaagtgctgggattacaggcatgagccactgtgcccagggatgattttcttaataatattttcttttttccagtttgctttattataaaaatacagcatgtaacacatataaaatatgtgccagtcaactgttaatgttattggtcaggcttttcatcaaaaataggctatttgtagttaggttttgaggaagtcaaacgttctatgtaaatttttgactgtgtagggctcagtgactccatgcccatgttgttaatggtattctgtacttgctcatgtatatttttgttttgaatgagacactgattatataaagaacagttatacaacttactaaaaataactaacaaagctgtgatctagtatatgtttcaatgaattatataaaaatccatttgttggctacaaaacaatttatgaaatggattttctttgttgtcttaaactggctactagaaagtttacagcataagaatatgcaatgcatgaataattccttacaatttatactgtgtggtatgaagactaagcctctgtctaatagtatctagtagatgttattattatccatatttgcttgtgaggaaaatcatacatgagaaattaattttattgacaaagggaacatgaactcactgttaggactggtatttagatctatataacctggacacagagttcacacttctaaaatgttgatatactgtatctcatcaatcaggatcttgttctagaagcactcaagtaatctgattgttttttacttatgaaaattgtataaaacatttgagtaaatgtaaataatattatgtagtggaattatttaggaaaatattatgtttgtgtgtattatacatgcagttcatccaatgtgtttggattttaactttttggaaaatatttgctgttgtaagcagaaatttctataatccatggttattatttgtataggagtaacttcttaaaagtaaaatgcctgggacaaatatacagatatatttatatttgtgtgtgtgtatagtatgtgtgcatatgtctatttatgtgtgtatatgtttatatatgtatatttctgaacgtaattaaaaaatgtacctgagcagctgttgtcaatttggcttatacagatcagaattaactccttttaaagaagtggctctggagtcatctgagttcattgagatgttcaagaaatattcaaagttgcagataattctatgatgcaaatacatcaaattgtttgtgttgttttaatgaaaaatgctgatttctttctgaaaataccatcatattaatttaagcaccaagactctcctcacatacttgctggaagaactttctctgaactaaccttcccattattggacattccttcattttatttcataagcgcctacaatgtctgtatcataacacttagcatattgtgtgagatatgatggtagaattagtagctttacctgaaagttttacgcgacttgaaaaaaactaaaatgtcatatttacttttacatgctgggaacttagcacatagtttagcatattgtagggattttaataaccatatgttaaacaaatgaatgaagatagtcatgtacaagctgagcagggggaaaagaggactttgaaactgcaagacaatgaaaaaaacggttttacccaggcttttgaggtggtaaaaataaagataatattggatatcaataacttatcaataaccatttagagcttccctgaaagtgaatgtaataaatatttagaaaggaaaaaataaaaactctctgctagatttatttcattctcttgcaatgcttaactctttcagaccaagattgaattagaaatttaaatttttccagaaatcaaagttcaggcacaaaagtcttcacaggtaaaatataccaaatatttttaaaataactcttgtttttccatccatcagcaatgaataatttggaaataaaattaagaaaacaattctacatataagaacattataaacatatgtatgaacaatatatatctctattatatatatttatataacacataaataaaatatagtgcacaagttttacactgaaaactagaaaacgttattgcaaaaagttaaagaagatctaaataaatgatgagcaattctaaattattgaattggatgactgaaaactaaggtggcaattgttcctaaattgatctggagatgctgtacagttgctatcaaaattccataacctcaaaaagagtgtgaaagtgaaagaagtcagataaaaatactacatattgtgtgaaatatctagaaaaggtaaatatgcacagagagaatgtagattagaagttgcctgagtccggaaggtaggagatgggattgacttaattggcatgacagatgattttgagttaatggaaaatgttctaaaactgaaggtcgcacattctataaatttactaaaattcattggattatattcttaaaaatgttgaatttattctgtacactttgtacctcaataaagctttttcaaactcatgaaagtgttgcaaaaccttagcattgaagaaaaaaatggcctgaaggattttttagattaaactctagaattggaaataaaaggcaacaacttaagaactagttttctctcaaagtagagatatatttaatcagctgagggcaataggaatgctcagagagcaactgagttctattttttagtgtctgtgggcagagacctcttgctggggctaggccagagagtctcagggagagagggtctgtgtgtcaccctcctgtgacagcatcagggaagcctgtcatctcatggtgtgcctgggcagaacagtagtaatggttcagtgaggggttgtagattggcagagtgcagccttttagaactctgcacaccccatcatgatgaaaagagcgtgaggtcatttgtgtattttcttcctacggaaaattgcatgctcttaggcaagcctgaaggtagtacttagggaagtaaaagtaaataaataaataaataagaaaaaatatataagaattttatatatatgtgtgtgtgtgtgtgtgtgtgtgtgtgtgtatatatatatatatatctccacacttatatgttccggaaataaaggaacaattcaagacaccaaaacagtgtctttttctggaacttatagtgtcttattttagtgtgggattaaacctaactacattttagttcctgaactaaaataaggtgtaggaacaattcaagaccattgagataaaagacatctgaatgtggtgaaaaaacaccggatatgaagtaaagaaaatgaagttttagtcttagttaatcttttaataattagtttttgacttcatatgaattacttgtcctctgcttaactatagaaaaataactgtaataaatgtcctctaacatcctatactcttgtatcattctaaaagagtgaggtgtaagataaggctgtaagtgtggctcagttaactgaaatgaaggtgaaggtgctggagtccttgttaatataacagatataacagagaataagcaaggaagccttattcctaatctggactgcctccctacagatttaagcatttctatcaataatcctcttcgttaattatagctactaacacaggcattctgacattgtttgactgacttatgtaaaatctcacatgaatactaaatagttatctactagatctattcttccaatattatgttttatatctttggtcttattgtggtattatatatatatatatattttttttttttttttttttttttttttttttgagaaggagtctcactctgtcacccaggctgtaatgcagtggccccatctcggctcactgcaaactccgcctcccggattcatgccattctcctgcctcagcctcccaaatagctgggactacaggcacccaccaccatgcctggctaattttttttgtatttttagtacagatgggttttcaccgtgttagccaggatggtctcgatctcctgacctcatgatctgcccgcctcggcctcccaaagtactggcttacaggcatgaggtataatatttttgaccccaaattggattagatcaacattttctttttacctgtaaacccatttgttttatgacttcttcagtatgcaatcaactttagtaaattattttaatttgaaagaacctgacaagttgctcctgatgagtacctgtggcaactggaaaatgaaagaaaattagatccttcatggtttggggcataatttcttcctaatatttttagtgattcattttaatgcttcttcaaatcatatcctattatgaacaaaaggagaagagtctcccataatgtgtagtaatagaattatttagtccaaggtaaccaacctcttgattttagggcagcataatatgtttgctcaattaagaaattttagtcagaaatcaaagaaacagcaattatcatctccaattataatagcccttttaatttattataaattataatttgcccatgatccacatgtataatatagcattaatgagaagctgactgtgactctttgaatgagtgcccaaaaactgcctacctgaaataaagtagcaaaattctactataaagccttgctaaaattgacttggtaataaaatcacttaacactaagcagcaaagatcttcattaccttctattattttactgtagcaatatggcctaaatgcaacattacatactcattgctaattttgttccctcataaagaatgtactcgtttctaaagaatgtactctttccttgctaaaaaccgtttcagaaaatatatattctgagacattattgatcccattaagaattctgtcttaattttctactggtaaatattaggatgtggaaaggaaaaatgtgagaatagcatctcccttttcacaattttcccgagaaacacatgatgttctcagaataaaaaaggcacaacttctagttaatcatcattttgaccttgtgtgtctgggtaacaaactaatgtgtagtgattcttctcattaacgtttatatgaagaataggaatggagtccctacaaatactatgcttctcccccagaaattatcaattaaaaatcatgaaatggcaattttaaccatgcaaccaataaatgatttggtgtaaaaacctaactctctctatatgtatatttttcaataaatattattatatttacaattattttaatggatgatagtcactcaagtttgtattagttcctaggaataatctgtaaaacaagccagaattgattcatgccgtctcagaccttacaaccttttaaagatgacagatatttaacttaaaaattttgaaagttataattttaatttaaaacataagattctgtggtaatctataacaggattatatcatattaagaggaacgtaaaaaacttttaagattaagtatgtttagactagacacaaattttgctcaaggaatatagtaatatggctaaggcctttaaaagacaagaaataaaacattacagtaaatataagcattacatgtttgataagaaatagaaaatgaagagcaatgtttgaagtagccaagaaaggacctctgaaaatcttgttttccataaaagcaatgagaacaacactggcaaagaaaaaaaaagtcaaaattatggaaattaatggaagaattgcaactatctgagggatgtttattttagaaaaagaggtaaatgttgggaagaacagtgaactttgtgttgttttcatttgtacaatttccattagctcccacctacctccatagtagccttgaaatccttcaactccaaaggcattggggagggaagaaagaggttggagttctgagctcctctaattgtacattccaccatcactatcaaaaacaaccaatggaaattgtttaactctgtggctgccttaggtgacaataacagttgttgcaacaaataacaaaatgatcaaaaaccttaaaaggaaaagcttggaaattaaatgagcataggagactttgaaacgttctgacatgtttcagggactatagatggttataggaagatgtagggctgtgtgcatgcccagggctaagagcatgacaaggaataatttgagatggctctaagcactcacttctgtttcttctagtgattctgtgcaggcaagaagtgaaggctaaggcatagctgtaaacagccttccagatctctgaatgaatgcccccaaacacagactggcttgccaaagactgggagacttactgattccagacatttaagaaaatctttgtccaatggttagctgacaactaaactaccatgtggaggggcttcattaaccacacatggcaaacaaagtattctacaaaactgttttagaaagtcctaaacaaacaagaaaaccaacaaaaaaacagcaacaacttttcactgctgagtctgatgttacctgcaggcttgtcttatatggcctttattatattgaggtacattccttctatacttagtttgttgaaagtttttttttaacatgaaattacattgaatcttatcaaatgctttttctgcatttttttttaaagagacaagttgcaatgttccccaagctgatctcaaatacctggcctcaagttatccccccacctcagcctcccaggttgggattgcaggtacacaccagcacgtctgtctttgtgaacctattggaagaatcatatggtatttatctttcattctgttaatattgtttgtcacatttattgatttgcatttgttgaaccattctagaatcccagggttaaatcccacttgatcccaatgcatgatcattttaatgcactgttgaatttggcttgttagtactttgatgaggatttttacatctatgtttatcaaggatattggtctataattatcttttcttatagtgtccttctctggctttgggtaattatagggtatgatagccttgcagaatgaatttggaagtgttgcttctctttaattttttgaaataattcaaaaagggttggtattaattcttctttgtttgttagaattcaccagtgaaaccatcaggtcctgggcatttctttgtgggagattgttgattattgattaaatctccttacttgttcttggtctgttcagattttgtattttttaatgattcagtgttagtaggttatatgtttctaaaaatttatccatttattctaggttatcagattgattggcatgtaattgttcatagtagtttcttatgatcctttgtaactgtatgccaacaggtatatggaaaggtgctgaataccattaatcatcaaggaaatgcagatcaaaactaaaataagatataactttatgtctgttagaataactattgataaaaaataaatatcaagtgttggcaagaatgtggagaaaaaggtgtccttatatattgttggtggaaatgttaatttgtatagccattatcaaaaatggtatggactttcctcaaaaagttatatatggtactactgtatgatctagcaatcctacttatgggtatttatccaaacgaagttaaatcaggatctcaaagagataccagcattcccatattcactgcaggatcattcacaataatcaagatacagaatcaacccaaatatccattaacagatgactagatcaagaaaatgtgaatatatataatggaatactattcaggcttaaaaaaggaaatcctgctatttgcaacaagatggcttctcctggaggaatttatgctaaataaaataagccagcagtgaaagataaatattgtacaatctctcatacacatggaatctaaaatagtaaaatttacagaagcagataatagaatgctgattgccaaggactagggagaaatggggaggtgatggccaaaggatggatagtttcagttatgcaagataaataagtgctggaggtctactgtacatcatagggcctatagctaacaatactgcattgtatacctaaaatttgctaggagggtagattttaagtgttctaacaacacatggagaaaaacaatgatgataatgataaaagggtggtgagaaactttaagaggtgataaatatatttatagctttgatgttctgattgtttcatggctatacatatttaactccaagttcatttcattgtacacattaaacgtgtacagcttcttatatgtcaaaaaatcgtaagtttctcaaggatataatctgggaaaaaacaccaagaacaaacctgaggagagttgtagaatctgttttccatagttgccacattgtattactaaaatatccagcacttaaggaaaaaaatcaagacattaaaaaaagtatgggcctatgcaggaaaagaaacatcattagaaattatgagggagcccagatattagacgtactagacaatgcttcaaattagctattttaaatatattcaaacaactagtgtctaaaaaattaaagcaaagtatgagaaccatgtctctccaaagctagaataccaatgatacaaaaattcaaaacaaataaaaattcaggagttaaaaaatgtaaaaattaaactaagaaaacgtatttgacagaatgaataacagaattgaactgccaaaaaaaaaaaagaagcaataaaatttagggatacagaagaaaaaaagaaggaaacataatataacctcaaggacctctggacaccttcaaatctaccaacatatacataatgggagtcacagagaagaggagagaaagaaagggacagaaagagtattcaaataaacaatggttaaaagattccaaaatgtgaagaaaagaccaattatacatctaagaagttcaatgaatccaagtagcataaacttaaaaggattcatacctaaacatttcataaggaaactgttggacaccaaagacaaacagaaaatattgaaagaagcaagagaagaacaacgcatcaagtacaaggaatccacaatcaggtcaacatgtgatttctcatctactaccatggaggccagaaggcagtgggacagcatactcaaaatgctaaaattaaaaaaactggcaaccagaattctatttccagcaaaaatatcattcagaaggtaagaaattaagacattgctagataaacaaaaactgagagaatcatcattagcacatctgccatacaataaatactgcaatttttagctttaaataaaaggaccttagagaataaattgaattgatgttacaaattttttaaaaaactcataaagtatctacataaacaattttaaagagtaatataagtgtgctttttactcttttttatcttatttaaaggacagcaaaataaaagaataattataaagctgtgttgaggggcatataacataaaaagatggagtttggagtttgcacgcaataatagcacaaaggagtaaggaggaaatgaaatatacagaaggaatttttcatgaactcttgaagttaagttgacattaatctaaacttgtcttttatttttaaaagattagctgtaatctagggcaatcactgaaaaaataacaatatagtaaaagaaaaaacaaaggaataacgaggatacaatagaaaatatctaacaaaagagaaggcagcaacagaggaacagaggaacagaaaaagacaagacacataggaaacagtaacaaaatgtaagacgttaatcttaccttatcaataattacattaaataaaatttatttaaacatactgatcaaaaggcagagattgacagactagctaaaaagaataatccatttatatgctttttataagagacactttagatttaaaggcaaaaagactttgaaagtaaaagaatgaaaaatgttatatcatgcaagataggcaaggagcaatggggttgaaattcttttctttgagtagagtggaatgaagcattataaaatctgagttcatagggaagttgggtaaggaaagaggatgtcaattaataaaggaataataaagcaagttacgaattggaaatccaatgtgattttagacattcagtggtattatttaagcagtcaggttgtaatagtaggaattgtgcattagaaaaattatagggctgggcgtggtggctcgtgcttgtaatcccagcactttgggaggccaaggcaggcagattgcatgagtccagaagtttgagaccagcctgggtgacacagcaaaaccctgtctctacaaaaaatacaaaaattagcagggcatagtggtgcatgcctgtagtccccgctactcagggggctgaggtgggaggatggcttgagcccaagaggcggaggttgcagtgagctgagattgtgccactgcactccagcctgggcaacagagcaaggccctgtctcaaaaataagaaagaaaagaaaaattgccatagatgtattataaattcattaaattcattagtaggagtttcaggcaagtgttatggattaacttgggataaggtcaaggaaatgacacacagatgataagaatggtggtggaggacttggttcatgagcaaagggaagggtattttgaaaagggagtggattacaaaaattgtagtttacagaatttaatcttaatattttgtaagtacaatgttaacagattatgtaactaaatagaaagcccgaaaatggtgctcaatgaatattggtttttgcagaaaaatggcaatgaaactgaagtaaattaatttataagaagaataagaaggcaaataaagtaagaaattatagtgtataacaaggaaagtgagtgtacgtgtttgaaaaattaaaaatacctatatgtgtatatataaatttatcctatctcctgtgtgtgtgtgtgtgtgtgtgtgtgtgtgtgtgtgtgtgtacctgtgcctgtctgatatctttttttttttttttgagatggagttttgctcttttgcccaggctggagtgcagtggcaccatctaagctcactgcaaactctgccccccaggttcaagcgattctcctgcctcagcctcttgagtagctgggattataggtatgcaccaccacacttggctaatttttgtatttttagtagagatggggttttaccatgttggccaggctggtcttgaattcctgacctcaagtgatccaccctccttggtctccctaagtgctaggattacaagtgtgaaccaccacacccggcctgatatcttattagagatggagggatacaatacccaatgttacgacagcactgggagtacagttacaatactatactccaagactagagttgctgcctaagaattttttgatagcagaaaagagttttatatgatattctaagttatgacctgccagaaatagtgaatttcctgagcatgaaactcttgcatttgatttgacacacgcatgcacacacacatttggaatatattctgtattgtgaatgatagatatccagcacctagaaaagtgactggcacaggaacagagctgggttacaataaaaatttgttgaatgaatgtatgaatttttgttagcaggatgcatatatggatgtattacagcaaagaggaaactcctgattaatccctaaaactttggcttttgagggtgactcccgaaataaatacaaattaagttattgaatatttttagtacaacctctcctcaaaataaaaaaatcttgaggcttatctcatgcctactaaattatattcttcatttaataaaatttcaaggtgatatgttacatgctttaaaatttgagaacctttggaacgtatatttatgcattctagaaacagagttgatgaactttacaaataattattttggattaataatacagtgttggtattgatatgttagagattttggaactcaggtcaatggacatggaagatttggactgaggaagcatggttctatcctatttagagcaggtatgtgcagagataaaattgagaggcacacttcattgaagcatcagcatgggtgaactcaagccgcctcagaaaatctccgaactactgagtctaataaagaaaggggaggataatgaagcagtatctcaaactctatggacaggaaaactacatgaaggatcagttgtcttactggcaacagcccagtgcaattagctgttgaaaataagcacatatggctttttgaaaatctgcttatgagaattcttccttaggcattttgagatgctgctactaatgtaaggaaagagagtagacaaatgaaagagcatgcccattctgaaacacaagcacagagatcataattttaaggtaaaagaccctggattctatatgggcccgtatttctttaaatagacagattaatctaatttataattatcctactcactttctttaatcagccattttgaatttttttaaaatttcagttgcaaaagttatacaaatacatttattattgtatatatttgactatatacatcaataactatatatatttgatgtgttgttttatttaccccctttgggattttgtaatttaaaaatataatagagatgtatttttaatttgagccacaatttttgaatacatcaaaatttcaaaaataaaacactatatgttcaatcctaataaatcataatgtctacaacagagttagcaaccaaaacacctaacaagtctttctttatcttagttttctgttggtaagtttggcatttatattctgcctgatataatgagaaattaaatattttatttactaagtttatttttcactagaatttagacatctatattgtgcttctcagtcagtatttactaggctattctgaagtaacaggcagctctaactctcagttactaataacaagacttatttcttcatcatttagcatgatcatgacagattggttttattgtggtcacttggagatgatctaatttgaccgtaattccactatcttaacatgccactatcttataatgtattcatgttttgatgtaggagaggaagggaggatgaagaactatatgccagatcattaattcttctgttcatatttcattgatcaaaacaatgcacatggtcatgtctaactccaagggattggcatgataatcctggagtgtgcccagataaaagggagaggaaaaaatatcgaacaataattacatctccaccacagtgtagacctcattataactgctatttcaagtttcttcttaatggcttagttattcactgctaggcattttagaccatggcacctggctgtcatgcaacttcaaatcaatatttgctagagaatatacaggtgtctttaaatttttaatattttcttctgttgccttcaagtataaatggtgactttgccaggtaaagaatacttcgtttaaatatttattccacaaatcttattttgattcagcctggttttgtttgtttgcatactaaaaaaaaaaaaaaactgtgttttcacctggatgtttgtaatattctttacacttgaattgtaataatttgactagagcaaattgtgttgtgtattgaaattgactaaattttcctgaaacactctgatcccttttaaattcagaccaggttcttcatgtcattatattttctttctttttcagcatttctacccacatttgttggctgctatagccattcaaaaagccaggatattatgcccatcagggctttaagatattctatgttaagttcctagttacgttggctatgttccttgagcttaaaatattcccatctttaatcacacataattgaggaaacatctaaagaaactcagtaatttctgaatgaaccaattttgttgcagcatcaatgtttcattattttcttatgtaaaggaaaatgctgcaaaaagtaacattaaatattttaatgacatctatatattgactaaaatttttagaattatacctcctgtttttgtcaatatgctctgattgtagatttattctttatccttttaaataacttgtttcattaataaatattggacctttagagtctactggtaaaattgagtaatcccactgtgatgtgtacttcccattgattagaactctaaaagccagaactactgtatgaccctgcaaccccactatgggatatatctccaaaagaaaggaaatcagtatatcgaagagatatctgcatttccacatttattgcagcactattcatgatagcaaagatatggaatcaacctaagtatccaccgatgaatgaatggataaagaaaatgtggtatatttacacaagggaatactattctgccataaaaaagaataaaatcctgtcatttgcaacaatgtagatggaactagaggacattttgtcaagtgaaataagcctggcacagaaagacaaatatcacctgttctaattcatatgtgggagataaaaaagttggtctcatggagatagagagtagaatgacagttgccagacactaagaaaggtagtgaggagagaggaattaaaaggaggcggttaatgggtacagaaaatgcagttagagggaataagatctcgtttggggtggcacaatgaggcaactatagttaacaataattaattcattgtctatttcaaaatagccggaagaatggaattgaaatattcccaacacaaagaaatgataagtgcttgaagttgttagaacccagttaccctgacatgattattacacattgtatgcttgtattaaaatatcacatgcactccataaatatgcacaactattatgcaaccataaaatgtaaaataaaatatgcgtacaaaatatcaaaaacaactagctgaaaatctgaaaagcaaacactagcacatggatggaggaggtaggtcaaaactagaaaaatgattatcctggtagcagttccctgttttcccctccctgtcatctgcagctgatagaggaaaacttccttttgttcctatctttttttttcctctccccatcttgtcctgaggtcagccccagtcatagagctgaactgcctcagcaatgcagcctgtggtgatacagatacctgagactcagagaagaaaaatctcttccatatagaagagccagggaaaggggtgttgttttgtaaagtatgttagaagttcctcattttttgttttcctttttctattctgacactgactgcaggcctgtccttgacctgaagctgcacagccacagcagctaggcgccaaagaccgtgagagaaagtcagttctttattttcagaataactgggggaatgagtgaagaatatggagcatttctattttttctcttttctcacaaagctttttttgtatataagggaaaaggaggtaattgtttcatctcccttccaactctaaaattccaaaatattagcattaccctttaattatcactaaatctatgctttaaaataatttctgaatttttaactttccttcaagattgaactctttaatgatatttaccagaattccttagccagacaatggtgattttcagtgtagttctcttttatctacaaccctatgtccaaagtctgttctggtgattcagagcaaagtctgctctgaatggtcatatgtattctcaaagatctttccatcttccaagtgttcaattcttggcatttgggcttttgctttaacacatcacggtctatttatttatgtgtcaataatttagcgaactttggctgtgtaacaacaaaaatgtctggataatgtaatatttgctcaacactgggatgatacttttatgccaatcatagatatgtgaaaaatgctcataaaatttggttgatatataaataatgtcaactgaaatatttcctcaagtatatcagcaaggatagagcattttgtattccaacttggtattccaattgaaaataaatgtgagatagataagaaggccaaacataactgtataggtatttgatgtccatttaatatcttttcacaaggatgggtattttaatcaacttgaaaattacccttcaaagaacttgagtttaaattgttagagtgataagtcatattttaatacaatgtgacttgaatgataacatttaatttcatggaaaatatgacacagtgtgactggtcaactctgctttagccagatacagagcatatattgcttttaagtatttaaaattatatttctataagccaaaatgatttgaattatctggatcaaagcttgttcaaagctttttaaaaggcacttctaatataatcgcttattcacacatagttttctgttgaatatgttctagttgggaatcatcttaattagctttttgataaaagattacatattttgtaaaaaattatcataaaatatttattcttttttatttgtatatacttaccatatagacatacctttcaatctactaaagaaagatgaagggtaactttccactctgtctctattcatatgtctttcttcaatttataaaaagtaaactttcatccactttggacaccctattaaaggtagagacatgccctattctggtgctctctgttggtcacgattcttcagttaaatgttaccaactacatggggcttttctggagatgtctgcattgatggtgttaggcaatgcgtgatcccagcatggatgacaagatcagggtctgccttgtacactgaaatctcccaattgtgcagccccagaccaaggagagaaagaagttcagtttgacaccatgtccaaagcagttcaaaatccaactttttcagattgatactttgtaacctgagttactttcttttacatttctctgctagttcaggacctggaagtgagaacagcctcctggctttaaggtctacactttttcacctctgagtcatgagcccagccctataacacatgctgtaaggaaaacctgggagggcagagagggcaaaaccttcttacatatctaaacattggtagtctagggaattaaattattattttcaaattaaaaatatttggctaatattagtgtagtctctatgtttttccacaaataaacgtttttcttattagaatggaaaattctagtgatacaaacttacattctggtgaatggcgggtcttgctttggttcaacggttgactgtttccaatttggacagataagtacctcatggtctaaccccacatgctagtgaattttattttgagatgaacaacatccaagtttataataaaatgttacactatttcatatgcttatttcctgccttcagggatctctcagggttgaaggataaccatgccaaggcaaatttctagcactgctatgtagccaaaatgtcatcttaggatcacttttttgaatagtacctaattttgattttacttctcagtgaatcaaaagaaatgctcagtatcataacttttttaaatggtgcattcgctttattttttaattgtcaaacaaaattctacacatgtattgtgtacaatatgctgtcttaaaatatacatacattgtggaatggctaaatcaagctaattaacgtatgcattacctcacttttttgtggtgagaatgcttaaaatctctattggcaattttcaagaataaaatacgttgttattaactatagtcttcatgttgtgctataggtctcttaaacttatttcttttatttaaaattttgtgtcattttgccaacatttctaacatccatcagcccatcccctggtaaccattattctactctgtacttctatgagttcaacttttttagaataatagcttttttgaatctaattccgaacactgaagatgaattgattgatgaatatgctatggtaaaattagaagcatggtattgtgatttgtgggcacagttgagaacattaataaatattataaaagacttaaaagatgacaacatttgagctggactttaattcacaagtaagagtacctaagtaaaaactgtaaaacttaatatttggaaacataacaagtactcattattgagagcctacagtttgtgggagacagcacaggagctgaaataaccaaactgattagcagttttaaagatattgataagttttgttatctatatcgctttaaaactaataactatttgcattactttacaagacacatgtttagttttcatgataagctgtgaacaaaatagacaaaagcactgatgatcattactaacttaagaaaaaaatcatgatagctaacatcttatgagaattcaatatgtcccagacactttatcatatatgattttttggtgtccttcgaaggccctttttggtaggtgtgatggcaaattttgtttgtcaacttgtctgtgccatgtggtgcccagatatttcatcaaacattattttgggtgtttctgtgagagtattttggatgagattaatatttaaatcagtgaaccttgagtaaagcagattatctttcacaatgtgggtggtcctcattcaatcagttgagctgattataatgaaaaggttggccacccttagagctagagaaaattctccagcagactgttttcagacttcatctgcatcagctcttcctagttctacagtagactgccttttgacttgaactggaacatagggtcttcttggtcttcagcctgctgggtcacaatgcaaattctgaatttgtcagtgtccataatcccatgaacccatttcctataataaatcttgcactctatatatccattctgtgggttctaatacagcaggcttatattagtaattttatagataggaaaactgcaacttagagatgttatgcaacttgcccaaggttgcagagcaataaggctgaaccaaaaattaaaatgaaggtagtttgacgctagaacaaatacattagattttactcaggttaaattcaatgccaaatagtataaagtctgacagtggttgaaaatcaatagcattaagtataagatggagccagtgggcttaacatgaaactgtaaactattttctttaagttctatgcaagtctatataaaatgatgatgctgacaaaaagaaagtatttttaacttgtagaattgtagtgttaaaatagagagtattggtcaggtgtagtggctcatgcctgtaatcccagcactttggggggccaaggcgagaggatcacctgaggtcaggagtttcaaaccagcctcattgcaaaaccccttctctactaaaaatacaaaaattagccaggagtgctggtgggtgactgtaatcccagctacttgggaggcttaggctacccgagaggtggaggttgcagtgagccaagattgcaccattgcactccagcctgggctacagagcaagactctgtctcaaaaataaataaataaataaaaataaaaatacagagtattttttgtctttcttcatttacccattaattcattatgtacataaatatgttttgagcttctaagagatatgtacatagaaacagaagtggataaaaggaataaggttgctgcccccatgaagtttgtgatctaataagcttaatggggacatatgcaaggtaaatataaaagaaatgcattgaacagatcagaagtttaatgatcattgagaatataacatatagggactaaatttagattagaaactcacagatatcttctctgcaggtggtgcattaaaatagaaacaatatttagcaaaaattaatcaaacaggaaatttgatggggaaaaagagggatgtatatggaagaggagaggagtacacactgcagaagagtgcaatccctttaaatttgtgtgtagaaaagaattgaatatattttagtttctgaaagaactgggataaatatattctggattttatgtccctttattgacttttatcatgaaggtggtatcaaaagtggaatttcattatttgatatacagggaggctctattgataatggtcattgaattctggggcactagatgacatcacgacaattttctggaagccaaataatagcctttatcaatggaattgaaatgctaattttacacccttgggaaagggtaaactgtgctttctgatgtgcattcactggctaattaattgaggacatagagaggaaatcgagtaggagggccatatttgacctaatagctgcccctccaaaaaatctttctttacaataattatgaccttccctcacctcctgtctctgttttgctcctaattaactcctacaaaatgcaaatcctccaggaaattctccctaaccaaacttctgtgtttaaatgcatatgttttctgttctcctattgtatcttaagcattttatctccacactagcattagattgtaattatcattttacaagttagttctcctacaaactcattgaggtcaagtaaaataaagctaaaccaaacttatttcacagtggcgttaaaaaaatttatataaagtagaaagcatgatcaaaggataaaaacctaggaagtaatagatgtgttaattttcaaatttcaggcttttaaaaaacaaatttgtgagtaataaatattttacaaatgtatagtcacgcctttgccagaatgacaatctagaaaaatatgctgctgtggatttaaatgcaaagtaatattttacttaaattttaattttaggatacagttaaaaatacatatgatttttacccaattttccagtattgtataccattttaactactttctttatatagtaataacattcagtctaatataatacagcatgactaattgcttgaaaactatcgctgttcttggatagaaaacaatacatttgcaaaataaaagtaagttaattttaataaaagaaatagccttgatatattataaagtgtatttagacagacaaatgttaaatgcatggtttgttgtctttttgctcatagtgaagattttctttcttgtaagggtccccaaaaaccattatcttggtttctcagaatacaaaataacagttgactaatgtgtgtaacagaacaattttatccatatggtatgaaagaaccagcctttttagtatgtggatgtcacaaagtgccaggaggaaaatcagcaatcttctcactttctacttttttctaatctattaaaattcttccagattgcctgttgcaactacagctgtgagcctgtgattgtcactagaccgaaatgtaactagactttaccattgagcatatacatgaagaatgagtaaatgttcattcccaccttgcccagaacagtacacagacataagttttatttgatgctattaaggctaatgggaaatatctaaatgtcaagccaatttctatcaatgtgtactaaacaactgcgttttgaattaggattaagtttgctattgaagagaaatattaattgagatcctgatgctatgcattttttaatctttagcgtaacaaacattttttaaaccatatatgtatataaaaatgaaatctacaattaaatattaatatttaacctggagatttaatttatatatcccttattaaaaatattgacataatttaaaataaaatataatatttatttgataatgttcaatagacttactgatatattaaatgatgatgataataataatgcttcaaattagtttgatggaggaaatcaatttaagcagagtacaatctggaaaaataagtcatgaaattttatgttcacataatttcccttttgtttcctacattttgaccagaaatgtgattgaataaaaatatataataaatatcaacagaaaaataattttatgaatgttgaaacctacattgcttttataatgtaaatgaaatatacaggtcacagtaatttaatgaattcattggtgttctatcattaagctcatattctctctatgagtggtgctttataatttcaaataatttttcagcttttatttacttattttcccaagaaattcatgaggatattaaccaaatatcattactctcattttacagaataggaagctaaattagagtcaattacctaagtcataaatgaaacacctagagcaatggcactgctttttaaaaaatgccaacatggtgtttatttcattatattgtacagtgtcttaaatagaatattttcaatgataaatgttgtaattgtattacaatggtgccaaggagtatgctgatgatttctatcattatattttaaaacataccatttgaaaaaatgtataactatattttgatactcaggttctctcaagctcattaatgtgttttcttttatttatttatttatttatttattttttatttttttattttttattatactttaagatttagggtacatgtgcacattgtgcaggttagttacatatgtatacatgtgccatgctggtgcgctgcacccactaactcgtcatctagcattagatgtatctcccaatgctatccctccccactccccctaccccaccacagtctccagagtgtgatattccccttcctgtgtccatgtgatctcattgctcaattcccacctatgagtgagaatatgcggtgtttggttttttgttcttgcgacagtttactgagaatgatgatttccaatttcatccatgtccctacaaaggacatgaactcagcattttttatggctgcatagtattccatggtgtatatgtgccacattttcttaatccagtctatcattgttggacatttgggttggttccaagtctttgctattgtgaataatgccacaataaacatacatgtgcatgtgtctttatagcagcatgatttatagtcctttggctatatacccagtaatgagatggctgggtcaaatggtatttctagttctagatccctgaggaatcgccacactgacttccacaatggttgaactagtttacagtcccaccaacagtgtaaaagtgttcctatttctccacatcctctccagcacctgttgtttcctgactttttaatgattgccattctaactggtgtgagatggtatctcattgtggttttgatttgcatttctctgatggccagtgatgataagcattttttatgtgttttttggctgtataaatgtcttcttttgagaagtgtctgttcatgtccttcgcccactttttgatggggttgtttgtttttttcttgtaaatttgtttgggttcattgtagattctggatattagccctttgtcagatgagtagtttgtgaaaattttctcccattttgtaggttgcctgttcactctgatggtagtttcttttgctgtgcagaagctctttagtttaattagatcccatttgtcaattttggcttttgttgccattgcttttggtgttttggacatgaagtccttgcccatgcctatgtcctgaatggtaatgcctaggttttcttctagggtttttatggttttaggtctaacgcttaagtctttaatccatcttgaattgatttttgtataaggtgtaaggaagggatccagtttcagctttctacatatggctggccagttttcccagcaccatttattaaatagggaatcctttccccattgcttgtttttgtcaggtttgtcaaagatcagatagttgtagatatgcggcgttatttctgagggctctgttctgttccattgatctatatctctgttttggtaccagtaccatgctgttttggttacttgtagccttgtagtatagtttgaagtcaggtagtgtgatgcctccagctttgttcttttggcttaggattgccttggcaatgcaggctcttttttggttccatatgaactttaaagtagttttttccaattatgtgaagaaagtcattggtagcttgatggggatggcattgaatctataaattaccttgggcagtatggccattttcatgatattgattcttcctacccatgagcatggaatgttcttccatttgtttgtaacatcttttatttccttgagcagtggtttgtagttctccttgaagaggtccttcacatcccttgtaagttgaattcctaggtattttattccctttgaagcaattgtgaatgggagttcactcatgatttggctctctgtctgtctgttgttggtgtataagaatgcttgtgattttttacactgattttgtatcctgagactttgctgaagttgcttatcagcttaaggagattttgggctgagacaatggggttttctagatatacaatcatgtcgtctgcaaacagggacaatttgacttcctgttttcctaattgaataccctttatttccttctactgcctaattgccttggccagaacttccaacactatgttgaataggagtggtgagagagggcatccctgtcttgtgccagttttcaaagggaatgcttccagtttttgcccattcagtatgatattggctgtgggtttgtcatagatagctcttattattttgaaatacgtcccatcaatacctaatttattgagagtttttagcatgaagggttgttgaattttgtcaaaggctttttctgcatctattgagataatcatgtggtttttgtctttgcctctgtttatatgctagcttacatttattgatttgcatatattgaaccagccttacatcccagggatgaagcccacttgatcatggtggataagctttttgatgtgctgctggattcgttttgccagtattttattgaggatttttgcatcaatgttcatcaaggatattggtctaaaattctcttttttggttgtgtctctgcccggctttggtattagaatgatgctggcctcataaaatgagttagggaggattccctctttttctatggattggaatagtttcagaaggaatggtaccagttcctccttgtacctctggtagaattcggctgtgaatccttctggtcctggactctttttggttggtaaactattgattattgccacaatttcagctcctgttattggtctattcagagattcaacttcttcctggtttagtcttgggagagtgtatgtgtcgaggaatttatccatttcttctagagtttctagtttatttgcatagaggtgtttgtagtattctctgatggtagtttgtatttctgtgggatcggtggtaatatcccctttatcattttttattgtgtctatttgattcttctctctttttttctttattagtcttgctagcggtctatcaattttgttgatcctttcaaaacaccagctcctgaattcattaattttttgaagggttttttgtgtctctatttccttcagttctgctctgattttagttacttcttgccttctgctagcttttgaatgtgtttgctcttgcttttctagttcttttaattgtgatgttagggtgtcaattttggatcttttctgctttctcttgtgggcatttagtgctataaatttccctctacacactgctttgaatgcgtcccagagattctggtatgttgtgtgtttgttctcgttggtttcaaagaacatctttatttctgccttcattttgttatgtatccagtagtcattcaggagcaggttgttcagtttccatgtagttgagcagttttgagtgagattcttaatcctgagttctagtttgattgcactgtggtctgagagatagtttgttataatctctgttcttttacatttgctgaggagagctttacttccaagtatgtggtcaattttggaataggtgtggtgtggtgctgaaaaaaatgtatattctgttgatttggggtggagagttctgtagatgtctattaggtccacttggtgcatagctgagttcaattcctgggtatccttgttgactttctgtctcgttgatctgtctaatgttgacagtggagtgttaaagtctcccattattaatgtgtgggagtctaagtctctttgtaggtcactcaggacttgctttatgaatctgggtgctcctgtattgggtgcatatatatttaggatagttagctcttcttgttgaattgatccctttaccattatgcaatggccttctttgtctcttttgatctttgttggtttaaagtctgttttatcagagactaggattgcaacccctgcctttttttgttttccatttgcttggtagatcttcctccatccttttattttgagcctatgtgtgtctctgcacgtgagatgggtttcctgaatacagcacactgatgggtcttgacttttatccaatttgccagtctgtgtcttttaattggagcatttaggccatttacatttaaagttaatattgttatgtgtgaatttgatcctgtcattatgatgttagctggtgattttgctggttagttgatgcagtttcttcctagtctcgatggtctttacattttggcatgattttgcagcggctggtaccggttgttcctttccatgtttagcgcttccttcaggagctctttaaggtgttttcacttttttattttaagcagatttatgaaagtgtagaaaaaactatgaataggtcaagaagtagcatatttttatatgataaaaattaaaagcttactttatgcttatagaagtatcttttaaaaaatatcgccatatctattccaaaatatactaattgatgtaataaaataatacaagtcatctttattttggaagaaaaattttgcagattaattttccaaagtgtttgactatacaaataacttttatttatttttctttttatttttataagggacagagtcttgctttgtcacccaggctggagggcagttgggcaatcatggctcactgcaacctctgcgttctgggctcaatggatcctcccacctcagcctcccaagtagctgggactataggtttgcaccaccacgccaggctaatttttgtatttttcatagagaccagattttgccatgttgcccaggctggtcttgaactcctagactcaagcccacccatcttgatctcccaaagtgctgggattacaagcattagccactgcaccctgcccaaataactcttccataaggaattttgtttatggatctcagaatttaaaatcattttatgtgttttaataatgttgacagattgcatcatgtagctgataatattactttacagttcatctttgtatccaaagtctacccaatgactaacccgtttctaattattactacaaagacgtcatgaaatgtgagtggtagtattgtaaaaatgttattactacctgtacacttctgtaaaaacagaagtcctcccaaatgtgcaaatgccatcatctcccacaaaactatgaaaaaaggagactcctggcaagttattcagttcatcaaaatgatgcaggatttttcttggtcactttgcaggccagggacctccacagctggtgatgtccctgtttgggcctcctttggcccccacacctgccgcaagaggcgccctgtccactctgcctgctgggccacgcctggtttgcgcaccagcctgggtcccacactggctgttgtgtaccagagcccacctgtgttaaaacttgtacccatgttctgcagtttctgaattctcccgcatccaagaagaatgagtttatgctaaaaattgaagggtgagggccgggcacagtggctcacgcctgtaatcccagcactttgggaggccgaggtgggcggatcatgaggtcaggagatagagactgtcctggctaacatggtgaaaccctgtctctactaaaaatacaaaaaattagccgggcctggtggcaggcgcctgtagtcccagctactcgggaggctgaggcaggagaacggcgtgaacccaggaggcagagcttgcaatgagccgagattgctccactgcactccagcctgggcaacagagtgagactccgtctcaaaaaaaaagaaaaaaaaaaattgaagggtgtggagagcagagaagaactttattgagtgagggaacagctctcagctgagaggggatgtgggggtggtcccccacctcaagtcgggtcgtctcactgagtatgactgatgactgggtccggggcttttaagggctcagaatggtagagtacatgctgattggattgtaagtatgccaaaaaaaaaaaaaaaaaaaaaaaaaaaaagctaaaacaaagacgccactcaaagataagcacagcagtgttaaaaaaaacaattagggaagggtagttatgtgtaaaataggtgaagggtgagtatcaattagaggaaagtgcaccaaacaagaagggaggttcacaatctggtcggtggatttatctgagacttgtagcttggttttcagttttaaactgtctttagtttgaaggtgaggtttcatcagggaccggcccctcctgccgctattgtaatgacttcaattaatcatttacaacatacatggtatggtgagatcatccccagatcccaaacagtgagcacccaacataaaaagcaatttgactgtttttttgattattaaaatatagatttttttttttggtttgtataatctgtgtttgatttaaaggtataatttgataactaaaaaaaaaagttttaatagaaatatcaccaatattgtctccagaattagaaaagtggttttaaaggggtaactaaagtaattttaacaagatgacatttccaatctacaatgagaaagaaatacaaatatttatgaactaaatagcacagcctttgtactcataatgcatgcatggcagaggaaaggtttaaaacggaattgatggaaacacaatagaaacaggaagtgttaactatcctttgtcaacctatgtcaaattaagtagaactaaagcaagtatgaagaagattagaaaattattttttactagtggatataaactgactcttctaactggaaaaagaggctataaatggaaaattgattgtgtgtcagacttcaagaataccctcaaactctcaaagcactttatataaagccagtctaatattaatgacaaaacatcattagaatacagtttaaattgtaacactttgtgattccatttgaataaatttcaaatgcaggcaaaactaatctatattttcaaaagtctggaaatatttgtcattggagtgggatactaataggaaggaaaatgtgttctgtagttctgattactttctgattcttgatctggatggtactacatgtgcctgctctctgtgtaattatatcaccattattgcaattataaattgtgtccttgtctctatctatgatacacttctctaaaagtctattgaaatataaaatcaggaaatctaatcgataaacaagtatatagctttttaaattaaaccttagtgaataaaattctatagtactattaaaaatgatatgaaataataattcaaaacaatataagtaattaatacaattcttccaatttataggtcaagaaaactatcacaggatcatctccaaacatatttaaaaagtatttgttttatttgattatatatttttgtttaaaaatacacatctacatatgtatacatgtgccatatgtagatgtgtatttttaaacaaaaatatgtaatcaaataaaacaaatactttcagtatttttttcattaaatcttaaagcatttcttatattcaccaaaaaaaacacatctacatttatatctatatgtatatctgtagttaaaatggttacattgaaaaagttcatatatacactgaagaatatatatttatgtaaacacatatgcatgtatatatatttatataaatatatatacacatgtggatgttgacaaatatatacaaacacatttattaagcacttactgagaacagacattctaattgctttacatgtaattacatcatattcaatatagtaagtctatgaattagatattattatagataagacaattgaactacagaattttaataattttcccagtattatacacaaagtaaaaattaaacaagagtaacaactagacaatttgacttcatattttctgtgtctttttatgcgttggaattcttctccaaatatgttatttaaagccaattctgtgacattaaaaacagatttccaatatagtcagaaacaagaaaggtattaacatgatttatctttcctttaaaaaaaaactggctgatgcaattaataaaaacaaataacggctataaaattcgtaataagtaaaaattgccattttgtatatggcatattctatatccagagaagctaaaattcaaaatccaaaaactactgtaaggaaatagataactccgtaagattactaggtacataacaggtcaaaaccagtaagtttcctacagaccaccaattgattaggaataataggcaataaattattgcatttattatagcattgataaatatctgtaaaaatgaggtaataagcaatagtcagctgatagatatatataaagagtagtttacaattcttttcttgggtttaaaaaagataattacattgaaatatatattatgttcatgtttggaaaggcaattttgtaataaaatgataatttttaatcaaacaatctgatcacaaaaaattactgacaaaatgtttgaatttgaaaaaatgtcatctttaaaaaacaaatgaagataaccagaatacttctggaaaaaatattcaaagcagatatcagaattcagatttggatgctaaaaactttagggattgtctacagcaaataatctcattttacataactagagaaaacataataatgatgttagtgtaacttataagttatttgggaaaaaacaaatttgaaattttaccttattctgcagtaaaaaaaatgctagtcaatcaaagttttaaatctaaaaacaaaaccacacaataaaatgcaattacacttatataatgtaaagaaattactgccataaaggacaaaggacccagcatcagtgcaatccttgctgataaattttaccatgctttagaaaagttaaaaaatatatattttgaaaaaaattacataatatatgtaactataacatacaaagctctaatagaaatcaaaatgaagaataaacaactttacaaaaattattgattttcaagtgaaattaatttacatgaacttatgcatagaaaaataaatctgttaagagtatacagtaaaagttgttcaatcttactgaaaattaagcaaaagagaatttcaaaacatgttaaatatttttacctatcaaattggaagaggtttgataacactcatttttcttaatggtttaaaggtggtgcattttcatacctgtggttgagacaataaattggagcatttgacaacacattaaaaaatttaaaatgtatatatttttaaaaccagaaatgacttggctgtcaattgactagttatgcagaaaagtacattaaaatatatctgtgaggttagtcattgaaatgttagttgtaataaaagaaaaatctgaagactataaaaattcgtgaataaaacaattgtcatataaactataaaatatagccaatggaataatatacagatttaaatacaaaagcaaaattatatgtggtaacaaaatatttccaataaataaactgcaaattaatgtgtatgacttcattcatgtatatgttcaatacatacataaataatgagacaactaacctgacatttacttttatttcagaaaaaaatagttgtcattaggacattttgtgtcgaaagtctggaaattgaaaaacaaagaaaaaatttgtttttgttttactgtcttcctatacaattgaaatatattaccggtacctgatatgtaagctaggtttcaaacaacacaggaaaaacataataaaattataaaacctaaatcttttatcaattggagtttatacttcatatatttggctttctgctcctttctctgcaagtctaacttaatggttttataatatgtatttcctattatagatatggctggaaataatatatattctttctacattttaagattatagataacattgcagtggacacctttgtaatgcatcacagaaccgatctctcacatctgaagagaaaaagacctatattaataatctattttaaagtcgttgtaatattttccaaattgattttcaatatttacagtgtttgcaagttgtattttctcagaataacaaaatacattcccaggtagcaatcactctgtatataaaattgtaataaatactatataaagttaaaaggtcacaaaaataaaattgtattcagtagaaattgagagacaaacatattattttatattattgcttcctacaattccatatcctaaggataaataatatagtttgccttatatcttgacatttttcatatatatgtatatatagatatcttttacttgaaatataattaattagtgtattcttaagtgctgacaatataggtacaaatatacttaatatctcatttttattttaatttttggaacatattgtgaatttgagatccttttcctatgtttaatattctttaagatttctttatatgccagttacctgcgttcttttacttataaatttgcagaaatactttgtgttaggttttttttaaaaaaattttttgtcttcattttcatttcctttccattgcctcacagaagttctaataccaataacctgggcaagcaacactactgataagtaaagtacaagaaactgtcatctaaacagtttttgattggctccttctatgtgagattttaactagtttttagttatacttagcatacctactatgttatttcattaacttttgtttatgcttttttttttttttttgagacagagtctagctccgttgctgagcctggagtgcagtggcacaatctccgctcactgcaacctccacctcctgggttcacgccattctcctgcctcagcctcccgactagctgggattacaggcacatgctaccttgcccagctaattttgtattttgagtagagacggtgtttcaccatgttgcccaggattgtcttgatctcctgacctcatgatccacccgccttggcctcccaaagtgctggaattacagtcgtgaaccaccgcgcccggcccgtttatgttttttctccccataattacttcctgtactttagaattaggaattaacttcatctaaagagtgttaagacaatctaaactgatgctccatatttcacagacacttctgtgtcactactttgtagttgcagtcgtgagatatgctttcataatttcaatatatttaagtttaaaagtggaattcagtaattcagtataagggagaaggcagcgcatgaagtaattattttggaatcagaggcaataattcaggctagtatcaatgttgctaaattatattaaaaaatcattgtttcatcatatgtgtgagaggaatctgaatgaaatcattagagttcacagtaagagaacagaagcccctatatcagtttagcatataccctatatacaggagaacacaagccccatatcagtttagcatatactatagctagtatattgctgcatttcaagaatattgccattattgtgtgtccaattctttaaatatattacacgggaaaacattttggtcttaaaagtattgaatacctttattgaaatggcacaccttacagatgtaagtatttatttggaaaatcatgttgatagttcctctaatattctgagtgacagaggggttttaagagttatgtttgtattagaagaaatttagtattatattagaagagattcttgccattgcttaatgtaattagaatcaccataactgtgccaagtcacacatacatacacccatgcaggcacacacacacttatacagtctcaaaggttgttttaacaagcaaacaaacaacaatgatgacctgagtgaagtaatgctgcttaaatgcttaaactgccaatttgaactaactaggatttcaagttgaattgcagtatctgttgtttatgttttgctctcatggggaattgtttacttactagaaaaatacgctttatcaaatctgtcattgttgtatgatgtacttactttcaaccctttccttatacacttctgaaaattcagatatgtggttcatacagcattaccatatgctggtaataataggttatattagagcaaacacacaaacacttttaatttttgaagtaactcattttaaattgttttcctacatgttataataatttcaaatattttaattgcaattataaataaaattgtaaactccttaaaggttatgtatatcaatgccataggttaaaatagaattttgcaataggttaaaatagaattttgtcataggctaaatagaatttgggatatgtagtttataggttttaaaccttcaatttgaagaacatcaagaaggtacagaaaaacaagaaatattaatcgcaaaggcaaaagtaatttatttctattgtgcatcagtgtatcaaatgactagagtcaggctgaaactttatagacaagaatgcacttcaatgccaatgatcttgctaaaaaatttgtgaaaaaggaagccaaaacaattttctccccccgcacccttttccctaaattgccttactttgttatagataaataagaatgtacaatggagaggaatgaatggcctatttcaccttgtattttggaattcctatagtttaagaaatcatattgattcctccagtacagaaaggtctacagatttcattttttatgacacatttaactggttccaataagttaccaatactattcatttttatttatttcttttgagaaataaataataagaaatcaaaataaaaacctaagccccctcccaactgaacagattttctctatgggcaaggagaccccagagaaactttacaatctgagttcccagccctgacaggacacgaggtcaagacaatcctcgttctactccctccagccatcaggacttttttcctaagagttcaacagaaacccaccctttggaaagtcttgctccaccactgatttctagacttgctccagtggggtgacgctgccccttcctttatgcagtttcaacgcagcaaaggaccagctttccttcctgatgagagagtcctgaccatgggctggctctcagcagcttttggaagctgcaccgttagtgcctcatgtgtcacctgcttcaccttttgacatatacagccgaattgttgtacagttacatgttaaatctccacctcaaatggagcatggtgccccctcatgaatattcatagctcctcctataacctgttgaatatgaatacttagccaactcttttagtataaactcctgtttcatttttcctcctttgaagcaactgctttttggttttatcaggaagctctgcttcctgtctgcaggttgtgataatctttttaagaaataaggtctcctttctaaatttagagatttttgttactttttccattgatattagcaatagctaactagtataatatgacctattcagattcataagaatgctttctactaataatttttttgaaaggatgttaatggagttgacttggcaccgacaaggttttgactctgattggtagataagaatttcgtccatttactaagtaaacgtaattcagaacttctataaataaactgctggggaaaaaaaaagaaaaaagaaaagaaaaaaagaaaatcacattacttttatattctggtatagttgatctggggaaagtggataatacctgtaaaattatagagaaatatcttaagtaaagaggttattcacacatatacactttgaccaagagcagtggctcacgtctgtaatcccagcacttcactgaggagggtgaatcacttgagctcagaattggcgacctgactggtcaacatggcgacaccctgtctttacaaaaaatacaaaagaaaaaaattagctgggctcggtggtgagtgcctgtggtcccagctacttgggaggctgaggcatgagaattgcttgacacctggatgcagagactgcagtgagccaagatcatgccactgcactccagcctggggcaacaaagcaagaccctgtctcaaacaaacaaacaaacaagcaaacaaacaaacaaaaccccaccatatacacacttactaaatgttatctttttctcctaattataaaattattttttcttgcttttgctgttgaattttttcaatggatcatggttttctgggcattttcataattgtaattttttcaagataaccttcacatttactgtatctttgttcttccagagatagtgtgtctagcacctagctgatgttcaaaaaattgttgttgggggctgggtgtggtggcttatgcctgtaattccagtgctttgggaggctggaggaagcggatcgcttgaggccaggagtttgaggccagcctgggcaacaaagtgagaccctgtctctacaaaaataaattctaaaattaggtgggtgacagatgtctgtcgtcctagatagttgagaggctgaggcaggaggatggcttgagcccaggagttggaagctacagtgagctatgatcacaccactgcactctgggctgagtgacagaatgaaactctgtctctctctcaaaaaaaataataataataataattgttgaactcaacaaacctaatttataatgacaaaatgcagttccccctgtatttctttagcacatttcttcacacaaatattcagtatagtttttaaattaaactgaaataaataacatgagagttggtcagatgtttagtgtggagtgctcataattattatgcagtccttgtcatcatgagcaaatagtgttttggttgttacttttaattttgtattttatttttaatatactataagatactagttattgtgtttggtctccaagtgtttgaaatatgactttagaattaatctgtgttcagctactagtaataaaaacaattgtcagtcattggcaggtaggagttggatatcttttgatgtaaagagtacttttcataaggaatattttatacccaaataattgaaaggttaacattttatgcatcagaatctggggtatttaattttgttttaattcagaataacatagtatatcaatgtatatagcactaattgcatatttagcaatatgttcattaaatgatttaaataacatataattacaaaagttgattattaatattataggtcatatacaatttggggttacaatgtaatttaatttttgcatcaggattatattatttttaaaaatgtatctgtaagacatatttacttgcaagtatgggaaagtttaacaaacttaggttgattttttgttatcttgaatgttcaggctagtggattttcttttaagaagaattcaacttgacaggaacatattgtgccactggaagaagtgattaatccttatattcatggattagtaaaatgacaaagtgaaaacttgtcataaatactaagcttagccaggttaattttcttttcatcctaagatagggaaaaaagctgtcttagaaattattaccttggttgtatgtgtagatatatttctttgagtttttagttctatctctattctagaaataaatatttctctcaaataggtatacattttattttttatttttcttccatagatttgactctcaaaatgaaatatttaaataaaatgcacatactgtagtagcatccctctatatatcatttttggttacaattatttctgttttcaagtaaaataatgtgtcaagggtatttattctcatgtcactgattttgaatattaataatgcccaaatgatagactttataagtaatatggtgtcatttgcattgcatggaatagcaatttatattatactactagtgttttatgtttcccttgaaaacttattttctattcaaatatgctatttaaaatatgatatgaaaatatattttttttgttttttgagacagagtctcgctctgtcacccaggctggagtgaagtggcacaatctcagctcactgcaacctctgccccctgggtgcaagtggtcttctgcctcagcctcccgagtagcctcagtctcccaagtagctgggactacaggcacacgccaccacacccagctaatttttgtatttttagtagagacggggtttcaccatattggccaggttggtctcgaactcccgacctcatgatccttccgccttggcctgcaaaagtgctgggattacaggcgtgacccacagcacctagaagataatgtaatttttaagtgaacttttaaatgtgcaacaatggaaataatgtgcgggtcaaaggaacaaatcagataaagaaaggtgaattattaactatgataaattaccaaaataaaagaaattctatttacgatgaatgttaaactttgtaaacattaaaaaacattgtgtattctcgtttatctgcagaacgtaaaaattaaaacaaactcatagagatagagagaaggatgattaccagagagaggaaaggataatgggtaggggaagggggatggttaatgagcacaaaaaatagggaataaagaagacctagtacttactagcacaacagggtgactgtagtaaaagctaacttaattgtatgttttaaaataattaaaagagtataattgagttgtttgaaacacaaagataaatgcttaaagtgatggataccttatttaccttgatgttattattatacattgcatgcctgtatcaaaatctcaatgttttggggatgccaaaaaagagattttatgttcaaaccttattatattgagccatgtaagattgccattttatagaacaaaaattttgaaatatttcacctaattcaagataataattcacaaaagcatagcattaaaatgtatctttctggtttccctttaaatcctggttcactcctgtaagcaaagtatattctatgtattgagatcatcttcaaagatagtagtttaaaatttttatatatcacaatgaaatacatatgataatgaaatataatagtaacatacttgtgtacttggacaatagatgaatatgttattacagaaaattgagttgctatctataaagtcattatattttagatctaagaaagacgatatgtcattcaaataatgtgtctttcaaataagaaatgacatttagagaaggactagcttgttcgagcttacacaaataatacaactgagagtataatccttgtcttctgtttcccaatcttagtgtggattttccagtggaatttagcatggtttgttacatggcttctgaagtaaaacttgcttaagtggagtaaggatgtggctgcagaaagtctattataagaagtaatcaataaggggaaaaaaatcctgatgggtgtaggagcctaagagcagaactaacaaccacgtactttaagtatggcaattctaggcaatttcagtgaaacactgagctagaagaggaatccagcctgaggtctttggtagcagatgctgggagcatcagtcaaggaaagaggcaaagtcagaaaaatgactaacataaagttctgggtttggaccaaagacaaaagttactgagtggttggagaatttctgtttctgagaaaaaggagtgaagcagccaggaattatggactgtgggattaagaaatctgatttgagaacctaccatcagacagtcattgtaaaacattaaagtccactggttatgggataggaataatagatattttcttttttgactgggaaataagttcatataaaataaattcttatgattaaatgcacttcagcagcttctaggcttgtattagaatggcagggaccatattaaaagttcctcaagatgcttctcaggacaagaaaggaaaaaattgataatcaactccatgaatacatactgctttttttgaaagccacatgagcaggattagaaccccccttctttgctccccatgatagtttgatttttctctccaatattgcacatatttctctctcctttgcattagattcagatgtttcatgttgtcttctcttacagactaccaaattatttaggataccttagtatctcctataggaaataacatgttttttttacagtcaataaaactgtattagtttatttattttcatgtgacatcatgatatttgtacctatctcaaaattattgtattaagtaatgtaggttaaattgctttgaaatttgttattacttggagtggaaataagttctatgatttttttgtccatgcttacaatgagataggttctatttgaaatgctttacattgcttaacacacttaatcccctcaataatcaaatggcacaggtacaattattattcccatttgctagctgaggaaatgagatataaaaaaatcaaaattcacacggtataatacttatgtagttatttacattgatgtagatataccagaggagtattgtaatttgcaatgacattgtataaatattcaaatttgacgaagcctttcctactgcttacaatccaagtggttttctataaaagataaaattcttgagtaatacataggttccattgttttaaacaatccagagaagagtttctgatattcttcaatgaagtatagtgtactggaaaagactagatatgaattcaaataacaaaatatgaaacctttgagaataagaactattaattattcattttttttcttttaatgaaatgatcccaaagactagtgtaatgtcttccccatgggaaacattaaagaaatgcttattcaacaatgttatatcgattatatgattagggtaaatttacttatcctctttgaaacttattatcttctcttttatgataaaaatatactgatacctatattctagttattggaatgagtatatcagaaatgatagatcttatgtgtttttaaaattaggatgtaatttttatttagcacatatgtgcacttaatttttgatatctcaactatatggccttagtaatgctccacttgcattaattgaacagatgtaataaaacataggttatatgtttgttgcatattggttacatttaggcaatatataaataattataaatacttttctaatcatgagaaacactgaatgcattgttcaagttcccagttaattagaatgttttggctccatcaataaccttgaagaaaaatttgaagaacaaatttgagaaacataaaataccaatcaaactaagaaaaacagatacagcatcatatacacaaaataatattctttattaattaatgggaaatattcaggatttgtaaagattaatttgatacttataaattattattattattattattattgagacagtcagacagtcttgctctatcacccaggctagagtgcaatggcgccgtctcggctcactgcaacctcagactccagagttcaaatgattcttctgcctcagcctcctgagtagctgagactacagctgcacatcaccacaccccagctaatttttgtatttttagtagagacagggtttcactatgttggccaggctagtcttgaactcctgacttcatgatactcccacctcagcctcccaaagtgctgggattacaggagtgaaccaccgcgcctggctgaaattattttttataattacatttaaacctaatcttgacatatgtttcaactctaatgttgtaaggaatcataaacatctttctgtaaacctacatccctcatgaactgggtatacaagttttgatcccttctaacttagaaacacatgcacactagcattaaaataaaggaccctggtctttgtgtgttctgttttgtgttatcttgctgtgtgaacttacctaagtgttatgggtacccctgctacctagtaactgtaatctgttacatgtgactctttacagtcaataatagatctaaaatactgtatttttcctcattctattctccgaatgcctgcctggttttgagtaagaatataaccgcaatcaatgataagactcaccattctttacttaaccctggccaatggagagatgaacttactatctgcccaaaccaataaataaccaaatcatagcagctatagaatggctcaataaataaattttaaaaaccagtacattttttttaaattatactttaagttttagggtacatgtgcacattgtgcaggtgaaaaccagtacatttttaaaagaaatagttatcctgaagtaatctttattaatgactataatctctcgtggcctaacgaataggttcctggccaatctttgagtaggtacattcaaagggaaagaaatggctcaaatcagggaaaactacatcacagctttagtattagaatacctgattagagtcagatgagaacaaactttgtaaaacattttactacctccattctgttctttcttgttatttatttgcagaaatcaataaaaggttgctaaaatgtaagcaaagaatttacaaagtatgagagaatcttacaaagaatatggcagctgagatctaatacaaaaaagtgaaacttagataagaaattacctaaccctctattttagaagcaaatcataaaaagggaagattgaagtctataagacgtcagcttgttcaaatattttaagtaaacaaataaatattttattctattttacattaaaatgtaggtttagggctttttttttaattgaaaaataagacctatgtttttgtaggcaggaatgaatctcaaattactaccagcctagtcaagacttagtgatttaaatcatgtgagcatcagtaaaaatacatatatggaagagataacaaatgattctagttgaatccttaagtataatttactttaggaggcatatgactctcatcaaaattgttgaaaattttatgaattcaacatattttacctactaccctgacatcacctttcagctatatatctgtgctttataacctatggttcataatctcttctggtgaggacacctttcaaagatattctcaattgcaagacacttccaaaaatatgcctatatttgacaatatgctcctgcaaaatacatgaagaaattagtctaagaacatctcaggcaacttttcctaatggaggaacagcattttatagatttcattatcacttgagtaaatcttaaattcttaaatttgtcagcgcaagaaaaaataaataaagttaaaatgatttccatgtgtgttttctagaactactctaaaagtaatatttatgtgcctaacgaagtgtgttagttattaaagaataatcacacaggtaaataatattaaatgctataataactattattaacagctctataaaatttgacataaatcttgtatctgaagctttcacttgcactatggtgtgcatttgatttgcttgtaacagctttttattgttactaaaagaaatatgcatatccatgcttcttggtagttttgcatacatgtgtaatttcactgtttccttcagctatcctcttcttactaacacataatcacaattgtcagtttaaaatatgagaataactataactcaaaagccaaagataatcaatgtcctttctatttaaggcatacatgtaaccttttgtcatcattggcttcaacaaacttgaaatagaatattatattttgttgagtaattgtaacctcaccccttccactttcacatattaaaacgtcttgcaatattcatgagtgactgttaaattgtatggaaataatagtgaatgtacttttattctgtaagtaaaagcttattggaaacttttctcaataatatcaccaaactagaatcactgcagttgagaactgatgcccttgattggcatcttgtcataagctctttgaattttatccaaaaaaactgagctaaatatgaatggtcatcttcttcattgaagtgtcattatttttgttaatgattattttgtcatcttagttggaactattaaagaaaaatagctgtaataactcaaaaagtagtttaacttgtcagttatttataaaagtattttccccaaaacactgattaacatatatttgtatagttatttagaaattttaaaacttaaaaaaaactttgaaaaagaatatagtaaaataagtcttaagtatgatagatctcattcagactttgtgtttcatgttcaaagtacagaggaacaaagttagtaaattctagaaaatgaaaataagtagaatctcatgatatctcctacaggtagcaagatataaagcaaaaggaatttctacattacaagaaattatagccatattattatcagtcagaaggtagcctaatgtattttaatgtttcagccttacttttacgaacattacataatccacatatatattaatgataggcatatttacagcatttatattgatttgattaaataaaaaatacagtttttatattatgtgtgtgtatatgtctttatattaattgataagaataagaattaattttggaataataaaacaaaacatatgccaaatactgaagcataaagcaagaatcaaaatacatcactgtaggaatgtacatgacacaaaactgaagaacatgagaaataaataaattagaaattatgtaagcttatatgaaatatttctgaaaaaagaaagttgaataatgtttgataaggtttgaatttgtgtccctgcctaaatcatatgtagaattgtaatccccaatgttgggtgagtggcctggtcaaggtgattggatcatgggggtgtactgtccccttgctgttctcatgatagtgagtgagttctcacaagatctggttgtttaaaagtgtatagcaccaccgcatttgctttcttttgttccttctccagtcatgtaagatgtacctgcttcccctttgctttctgccataattgtaagtttcctgaggcctccccagccatgcttcctgtacagcctgtggaactgtcagccaattaaacctcttttctttataaattacctagcttgaggtagttcgttatagcaatgcaagaatgaactaatacagaaatttggtattggaagtggggcattgctataaagacacctgaaaatgtggaaaagactttgaaaccgggtaatggggagaggttggaacagtttggagggtgtagaagaagataggaagatgacaaaaaatttggaatgtcctagagatgtgttgaattcttgtgaacaaaatgttgatagtgatatagacaatgaagtccaggctgagggggtctcagatgaagatgaggaacttattgggaacagaagcaaaggtcagttttgttatacattagcaaagaggttggaggcattgtgtccctgccttagatatctgtggaactttgaacttgagagaaatgatttaaagtatgtagcagaagaaatttcaaagcagcaaagttttcaagatatggcctggctgcttctaagagtgtatgtttatattcataagcaaataaattacctggagcagaaacttacatttaaaagggaagcaaagcataaaagtttgaaaaatttgcatcctgatcatgtagtagaaaagaaaatcccattcttgggggaggaattcaagctggctgcagaaatttgcatgagcaaagaggtgctaaatgtaaatagtcaagataatggggaaaataccttgaaggcatttcagagacttttgctgcaatccctcctatcacagacccagacacataggagagaagaatgatttagtgggccaggaccacgatcagagccctgctgctctgcacaaccttaggacattgctccctgcatcccagctgctccagctcctgctgtggctaaaagggccccagatatatctcagtccactgctccagagggtaaaagttgcaaccttgtttgcttccaagtggtgttaagcctgcaggtgcacagaggacaagagttgaggcttgggagcctcagcctagatttcagaggaggtatggaaatgcctggatgtccaggcagaagtgtgctgcaggggcagagccctcacagagagcctctactagtgcagtgcagagggaaaatgtggggttggagtccccaacacatattccccactagggcactgcctagtggagatgtaagaagagggccactgtccgccagaccccagaatgttagatccaccaacagcttgaaccatgcttctggaaaagctgcaggcactcaatgccagcccatgaaagcagatgacgggacctgtatcttgcagagtcaaagggtgaagatgcccaagactttaggaacccatgccttgcatcagtgtggcctgggtgtaaaacaaggagtcaaaaaagattattttggagttttgagacttaatgactgtcctgctgggtttcagatttgcatgggacttgtagcccctttgttttggctgatttgtcccttttggaatggattgtatttgcccagtgcctgtacccccattttatcttaaagtagccaacttgattttttttattttacaggctcataggcagaagggactttcattgtcccagacaagactttggaggtaaacttttgagttactgctgaagtgaattaagacttgggggactgttgagaagggataattgtattttgcaatgtgagaaggacatgagattgtggatgggtcaggggtggaatcatatggtttagatttgtgtccctgccaaaatctcacgtagaactgtaatccccaatattgagggaggggtatggtcaaggagattgggtcatggggctgggcttcccccttgctgttcctgtgatagtgagttctcatgagatctcattgtttaaaagtgtgtaggacctcactgttcactctgtttcttctgctcctaccatgtaagacatgcctgcttcccctttgtcttctgccatgattgtgagtttcctgaggcctcctagccatgctttctgtacagcctgtggaattgtgagccaattaaacctcttttatttataaattacccagtctcaggtaattttttatagcaatgtgagaacagactaatataatgttacatattgatttctataaatcctcacagagaattattaaaagaggtcataaatatgtatatattgaaaaattgtttttaaagaagcataataaataaataaacattcaaccatatgtagatttctgggttttttgttgtttgtttgttttgatatggattcttgctctgtcacccaggctaaagtacagtggcgtgatcatagctcactacagccttgaactccctgggctcaggcaacacccctgcttcaacctcctgagtacatggggttataggcacacgatgtcacacccagctaatttttattttttttttttagtttttgtagtgatggggtcttgctgtgctgaccacactgtaaacttctctctaacttaaataatctgagtgattatccttatagagtataagttaagggaatacaataaaaatagaagatgagcccttgcttccaagatagccaaatagtaacagctccagtctgcagctcccagcgagatcgatgaaagagatgggtgatttctgcatttccaactgagatatctgtttcatctaactggggctggttggacagtgggtgcaacccatggagggtgagctgaagcagggcggggcatcacttcaccccagaagtgcaaggcgttgggggatttccctttcctagccaagggaagcagtgacagactgtacctggagaaaatgtatacccctgaccaaacactgtgcttttcccacattcttagcaactggcacaccaggagataccctcccatgcctgcctcagtgggttccacacccacggagccttgctcattgcagtgcagtagtctgagattgacctgcaacactgcagcttgatgggggtttaggtgtccaccattgctgaggcttgagaagcttacaatgtaaacaaagtggcccagaagcacgaactgggcagagcccaccatagctcagcaaggcctagtgcctctatagattccacctctgggagcaaggcatagaagaacaaaaggcagcagacagcttctgcagacttaaacgtccctgtctgacagctctgaagagagcagtggttctctcagccagtgttcgagctctgagaatggacagactgcctcctcaagtgggtccctgacccctgtgtagcctgactgggaaacacctaccagtaggggctgatggacacctcaaacaagtgggtacccctacgggacaatgcttccagaggagggattaggcagcaatatttgctgttctgcagcctccactggtgatacccaggcaagcagggtctggagtggacctccagcaaactccaacagacctcctgcagctgacagacctgactataagaagaaaaactaacaaacagaaaagaataacatcaacatcaacaaaaaggacaaccacaccaaaaccctatctgtaggtcaccaacatcaaggaccaaaggtagataaaaccacaaaggtggggagaaaccagagaagaaaagccaaaaattccaaaaaaacagagtgcctcttctcctccaaagggtcacagctccttgccagcaagggaataaaactgggtggagaatgaatttgatgagttgacagaagtaggcttcagaaggtcagtaataacaaactattttgagctaaaggagcatgttctaacccatcgcaaggaagctaaaaaccttgaaaaaatgttagatgaatggctgtctagaataaaccatgtagagaagaccttaaatgacctgatggctctgaaaaccatgtcacaagagcttggtgatgcatgcacaagcttcaatagccgattcaatcaagtggaagaaaggatatcagtgattgaagatcaaattaatgaagtgaagcaagaagacaagattaaagaaaaaagagtgaaaaaaaacaaacaaagcctccaagaaatatgggacaatgtgaaaagaccaaatgtgtatttcactggtgtactggaaagtgacagggagaatggaaccaagttagaaaacacttttcaggatattatccaggagaacttccctaacctagcaaggcaggccaacattcatatacaggaaataaagagaacaccacaaagatactccttgaaaacagcaaccccaagacacataattttcagattcaccaaggttgaaatgaaggaaaaaatgttaagagcagccagagagaaaggtcaggttacccacaaagggaaacccatcagactaacagcagatatcatctcagcagaaactctacaagccagaagatagtggggtccaatattcaacattcttaaagacaagaattttcaacccagaatcttatatccagccaaataagcttcataagtgaaggagaaataaaatcctttacagacaagcacatgtggagagattttgtcatcaccagccctgccttacaagagctcctgaaggaagcactaaagatggaaaggaaaaaccagtaacagccactgcaaaagcatgccaaatgataaagaccactgatgctatgaagaaactgcatcaattaacaggcaaaataaccagctaacattgtaattacaggatcaaattcaaacataaaaatattaaccttaaaggtaaatgggctaaatgccccaattaacagacaaagactggcaaattgggtgaagagtcaagacccattggtatgctatattcaggagaccgatctgacttgcaaagatgcacacaggctcaaaattaagggatggaggaagacctaccaagcaaatggaaaacaaaaacaaaaacaaaaacaaaaacaggggttgcaatccttgtctctgataaaacagactttaaaccaacaaagatcaaaagagacaaacaaggctactacataatggtaaagggatcaattcaacaagaagagctaactatcctaaatatatatgcacccaatacaggagtacccagattcataaagcaagtccttagagacctacaaagagacttagcctcccaaacaataataatgggagactttgacaccccactgtcaacattagacagatcaatgagacagaatattaacaaggatattcaggacttgaactcagttctggaccaagcagacctaatagacacctacagaactctacaccccaaatcaacagaatatacattcttctcagcaccacatcacacttattctaaaattgaccacataactgatagtaaaacactcctcagcaaatgtaaaagaacagaaatcacaacaaactgtctctgagaccacagtgcaattaaattagaactcaggattaagaaactcactcaaaaccacacaactgcatggaaactgaacaacctgctcctgaatgactactgggtaaataatgaaatgaaggaagacataaagatgttctttgaaaccaatgagaacaaagacacaacataccagaatctctgggacacatttaaagcagtgtgtagagggaaatttatagcactaaatgcccatgagagaaagcaggaaagatctaaaattgacaccctaacattacaattaaaagaactagagaagcaagagcaaacaccttcaaaagctagcagaaggcaagaaataactaagatcacagcaaaactaaaggagatagagacacaaaaaaaacttcaaaaaaatcaatgaatccaggagctggttttttgaaaagatcaacaaaattaatagaccactagcaagactaataaagaagaaaagaaagaagaatcaaatagatgcaataaaaaatgatggaggggatatcaccaccgatcccacagaaatatgaactaccatcagagaatactataaacaactctacacaaataaactagaacatctagaagaaatggataaattcctggacacatacaccctcccaagactaaaccaggaagaagttgaatctctgaatagaccaataacaggatctgaaattgagacaataattaatagcctaccaaccaaaaaaggtcgaggatcagacagattcacagctgatttctaccagaggtacaaagaggagctggtaccattccttctgaaactatttcaatcaatagaaaaagagggaatcctcccaactcattttatgaggctagcatcatcctgataacaaagcctggtagagacacaataaaaagaaaaatttagaccaatatccctgaagaacatcgtgcgaaaatcctcaataaaatactagcaaactgaatccagcagcacatcaaaaagcttaatcaagtcagcttaatcccccgatgcaaggctggttcaatatatgcaaatcaataaatgtaatctgtcacataaacagaaccaataacaaaaaccacatgattatttcaataaatgcagaaaaggtcttcaacaaaattctacagccttcatgctaaaaactctcaataaactaggtattcatgcaatgtatctcaaaataacaagagctatttatgacaaacccacagccaatatcatactgaatgggcaaaaactggaagcattccctttgaaaacgggcacaagacagggatgcccgctctcaccactcctattcaacatagtgttggaatttctggctagggcaatcaggcaagagaaggaaataaagggaattcaattaggaaaacaggaagtaaagttgtctctgtttgcagatgacatgattatatatttagaaaaccccattatctcagcccaaaatctccttaagctgttaagcaacttcagcaaaatctcaggatacaaaatcaatgtgcaaaaatcacaagcatttgtatacaccaataacagacaaacagagagccaaatcatgagtgaactcacattcacaattactacaaagagaataaaatacctaggaatccaacttacaagggatgtgaaggacctcttcaaggagagctacaaaccactgctcaacgaaataaaagaggacacaaacaaatggaagaacattccatgttcatgggtaggaagaatcaatattgtgaaaatggccacactgcccaaggtaatttgtagattcaatgctgttctcatcaagctaccactgattttcttcacagaattggaaaaaaaatactttaaacttcatatggaaccaaaaaaaaaagcccacattgccaagacaatcctaagtaaaaagaacaaagttggaggcatcactctacctgacttcaaactctactacatggctacggtaaccaaaacagcatggtacttgtaccaaaacagatatatagaccaatggaacagaacagaggcctcagaaataacaccacacacctacaaccatctgatctttgacaaacctgataaaagcaagcaacggggaaaggattccttatttaataaatggtgctgggaaaactggctacccacatgtagaaagctgaaactagatcccttccttacaccgtatacaaaaattaactcaagatggattaaagacttaaatgtaagacctaacagcataaaaaaccctagaagaaaacctaggcaataccattcaggacataggcatgggcaaagacttcatgactaaaacaccgaaagcaatggcaacaaaagccaaaatggacaaaaaggatctaactaaactaaagagcttctgcacagcaaaagaaactatcatcagagtgaacagtcgacctacagaatgggagaaaatctttgcaatctaaccatgtgacaaagggctaatatccagaatctaaaaagacttaaacaaatatacaagacaaatgcaaacaaccccatcaaaaagtgggcaaggatatgaacagacacttctcaaaagaagacatttatgcagccaacagacatatgaaaaaatgctcttcatcactggtcttcagagaaatgcaaatcaaaaccacaatgagataccatctcacacaagttagaatggcgatcattaaaaagtcaagaaacaacagatgctagagaggatatggagaaataggaacacttctacactgctggtgggagtgtaaattatttcaaccattgtagaagacagtgtggcaattcctcaaggatgtagaactagaaataccatttgacctagtgatctcattactggctatatactcaaaggattataaatcatgctactataaagacacatgcacacgtatgcttattgcggcactattcacaatagcaaagacttggaaccaacccaagtccatcaatgatagactggattaagaaaatgtggcacatatacaacatggaacactatgaagccataaaaatcgacgagttcatgtcctttgcagggatgtggatgaagctggaaaccgtcattctaaccaaactatcacaaggacagaaaaccaaacaccgcatgttctcactcataggtggaagttggacaacaagaacacatggacacagggtgcggaacatcacacaccagggcctttcatggggtagggggctgggagagcgatagcattaggagaaatacctaatgtaaatgatgaattgatgggtgcagcaaactaacatggcacatgtatacctatgtaacaaagctgcatgttgtgcacatgtaccctagaacttaaagtataataataataataataaaattgaaggccgggcgcggtggctcatgcctgtaatcccagcactttgggaggctgaggcgggtggatcaagaggtcaggagatcaagaccatcctggctaacatggtgaaaccccatctctactaaaaatacaaaaaattagccaggtgtggtggcgggcacctgcagtcccagctactcaggaggctgaggcaggagaattgtgtgaacctgggaggtggagcttgcagtgagcggagatcgcgccactgcactccagcctgggcaacagacctagaaaccttatcaaaaaaaaaaaaaatgctactgagattttactgctattgctactaacacaaaataaaatagttaacattgacagaagtttagccacaaaaatatatgggtttgggataaatgtccacactgtcatttgcctaatatgatgattaaatcagctgccgcatgtgtggtgaatggcagatgagaagaatacactatatccacaactaacacaattatacaaacaattatcatcaatgatgggacatccaccagtctctcaccaattctacccaaattgctcaaactactaatgaaaagtaattccctgaaagtttttcatactatccttcaataaatgttggtttaaaaaatgtgcattttaaaattttccatttcaagaaaatatttgaaatagaaattacaaaaatctatgttcaatttttttgaaactggagaaagagaaatcctcattatgtagtcacagaaagctttacaaaatgacttctagttatgtagaaagcagaatttttaagataatttatgaacttggttatcttgctaaggagtttcacaaacaaagtgttaaagtgttcccttgttccttcttgatgctcatagtaaaaggaggtaaattaagaaaataattgtttaacacaagcaaccagaactgaatgattctgaaaaaaatcacagcctctccaaatagtaaaagttactgaaattaaaacagtgtggtttaaagaaaaagttgagttctctttgagcaatcttttgcaaaaaccttagaaataccaaaaggtcaaagtattcagtcacaaaaacgggctcattcaagagattgaagctgttctgttcagattccttcaatcaaaccagagaggctataggagtattaaggacattatctctcagccatctctccaggagccaaagatagagaaggagttatcacgaaaagatctctggacatggctttcatcgaatgaagtatcctaaaaggaaaagagagtaaatgaggaaaataagctgatggacccccaactggctgatcaggaagaaggctaataaagctactcaactatgaatgagttaaccttcatgaacaatggaagggttactaaaagggtagaacctagatgatgcagccaagagccatagaaaattatccctaggtcttgaaacctaactaagaaacccatttttttttctggttggatttcacaactgctttgcacattaagtgtgttttttcttctgttctcccccttttgaactaaaatgactgtgggtttaaacacatgcattgccagcactgtatgttgcaagttttgaggacagataacttggctctctaatttcatatgtccacagatggagaataattgtataccagcagtggtagttagtggatttgaatgacttctataacaaggtttttgaaatttgaactgacaatttagatgagattttgtattttgtggtgatgagatgtgattagatttagataagagattttgcataagagctgacactgtgatgagatgaaacttgagaacactggaattgaatggacttatttttcattttggaggaatatgaatgcttgggagccagagagtgggctatgataggcaaaatgataagatgatttggttcccttcatgggcatgccctgtgtaatcccctcctcttgagtatgaataaacctgtgaaccagatggtatatcattcctgtgattaggttatgaacaaattgactttgacttcatcatgagtgagccttgcttaaaaggcactggggccttcctgaagtcagagatatgggaggcaggagaggatctataaatcgggacaatataggaagaaagtgtgggtggccctaggatctgagtacaatctctatccacaggacaacaagaacttagtccttcagccgcaaagaactgaactctgccaaaaccctccagtagcttatagatgaatctattcctttagcctccagataaggacatagcaggccaacatcttaattttagccttctgagatactgagaagagtactaagccacttcatacctggacttctgagctccagaactgtgagctgatgaattactgatgttttaggctgctaactttgtggtaatatgttaaacatcaatggaaaactaatatagcatagtaaatctttctccatctctttacttttaaactaattttctatatatttatagtgtgtttctggtaggcaacatagagttggttatttttaatccaatattacagtcttttccttttgatggaggtgttaagttcgttaaattataatttgattattatttatttaattttaattatattatcttgctatttgctttctatttgtcctatctgcttttcattctccttttactctttttctgccttttttggggaattggataatttttataattgcattttattttattttttgtaggtttactagttataatttttgttttgttaatttaatgataggtttatttaatgttcatagtacaggcctttaatttgtggccgtctaccctgcaaatgatattatcatttctcatgtggtataaataccttaaaatggttcacttccatctgcttcctcccagccactgggtatttttcatacagttccttttgcatttgttttagaacactgattacattgttatttacacccgcagttaccatttttgatgcttcttatttctctgtatagatacatattgtcatctgatatcatttcccttttacttgatgtagttctttagcattgtagtgtgtttactagtgatggatactttctgattttttacatctgaaaaaaagctttatttgcttttatttctgcaagatattttcactgctataacattgtacattgacagtctttttatgtcattcctccactgtcattttactttcattttttctgatgagaaacctgatgtaatctttgacatttttcttctataacatatgtgaatttggaactctggttgcctccattatatattttaatcaatagtttggggctacttgattattatgaaattactgtaatgttcatgtttcttgagctttgagtttaccgatgttctcaaatccgtgtattttcactatatttggaaggttgggaaccaattttgtttaaatacgtttttaagacagagatacctgtacgtcacttatgcaggacaaaataattcgctttcagagtatttaaattcacaacaatttgatagttatgaagaaaccatttcttattcactaaattgaaggcctgaatcagtccggattaaaaattgtctaactcattttaggttaaaataaaatattgacctatgtatattctgccttgacagaaaaatgcacagatctaagtcaaaatattaatttttgatagatttaaaaacaaattatgtcaatttcaatgttctctgacagcagattttagctgatgaatagaagatgagggtaaattgacataataggaattgtttaatttaattaaacaaaagatgctgggagttcaccaggcctaaaataacctgacaattacaagaggagacacaatgaaaaattaatgctcatgagcattttcttcccaagaagatgttatcagattggaaacttaaagtagttttttattaaaaattgtttttatctgtacccttcttctattgacacaggattatttaggtgccacttcacctgcctgaaagctctgtggctggcagtgcttctgcttgagttttactcggtactgctggactcttggcctggcaggcagcactcggcttgcactactggcacagatcccatgcctgctgagggtgagctaggcaaaagagtggcaagggttgtgtgagtgagtgagcacagggtccagccagccagagtgtacagccaggcaaagtggggcaggcagctccaggtgctggcactggtgccggctccctgtgagactgcggctggaccactcatacctcaagtggcttccaccttgagtgccagagtctggatgaggggaacgcagtggagcctgaaatcttggagacaccagcaactatggagccccaagggtgtgttacagtgtgtcacagctcgttcgttaccgttgtttacagaacggcaatcaaggcgggtatgtttcagctcgctcatgttatatctcgtttgatcctgccacccagttctctcccgtggctcctgggctggcctggccctgctgccacttcccatcatgtggggcagccgcacagcaccggtggagggaaggagggctacattgttacagcttttttggcacccaccatttggcagatcccaggttcttgttctgcatccaaaaagaatgaggttatgtggataaccagagtgagcaaggtggagaagagttttattgagctacaaagcagctttcagcggagaggtgacccaaagtgtgggtagccccgtcctgaatgaaggtgggtggtcccatcatgtggctgagtcccgggttattatgggctgagaatgggagagtgtgtgctgattggtccatgggcaggcctggaaaaagcaccatttgattggctaaaagacgtcaaggaagttcccacttcagcacgtggactctacccagaactagcagcctggatttcaggcttcaggctgtcttttggcttgaaggttgggcttcactggggacctgctcctttctgcctaggaatttgtctgcctcctgccactatcagtatcttctggggataaaattgcatacatatttttctgtttgaggtcatctcacagcttacttatgttcttttcaccctttgtattgtatttttttctttctgaatcatttctgttattagaatagtgtcaactactgtatttcaataattttactaatattttcttctgcaatgtctaatgggtagaaaagttttcatcacatatttcgtagttttcatttctcgaattttaatttggatcttctgtagtcttcattttctgttttcaacatatcagacatatataatgcagttgcatatttggtataagatccttgtcttctaactctaacttcagtttcagtattttggttgttttttctcatcatcgaacttatttttctgcttctcgccatgtctaatattttttcattggatttgaggcattgtatttaatttttttaggtactgaatagttttattttgggactcatttaagttctttggaaccacttgattctttctgacagtattgttaagatttattaagggttgaccagaatagcatttagtttagagctaattactgagcccatgctttgtgcatcatgaagtttttcagtctagaaaaagaaacagttcctggacctctatgtcaccggtactgttacctgtaactcaattcagatgtgttcacttctccatatttgggttgtcttctcctatgtatacaccactgaatttttgatagagacccttctcagagctatgcagttctcactcctctctggtgatttgtcctatgacctcaagctttcttgaactccctaaggtctcaattccaactactatattccaagcttggaaattgtaacttgccaaatactaaatagatggacacattctgtcatgagatttctgaagctctcaatattggaaatgtttaaacaaagtcaaatttatttcattattaaaattactttgaaaagatcaggtaggataatccttatttgcaggcacataaaaaagtatcttgggaattcaactgatatttagtattaatacaagatttgtggaataaaagaaaagatgtagtgtacaaaaaatgtgttgcattcagagtgtctatacataaaaacacacacatgtcatttatatattttgatataggtttatatttttaaagaaaataataagcaaaaagtattctttatactttctaatatttcaatccacagtttacaattttcaaagttgagcttaaaattttaaatgaaatgaattctgtgaaaaaaactataggggttcaatttgggtttcttctccctgtcctacagcatgaaaattctctcaaggcaataagctgagacaaacagagaacttgcttcatttgtttcttgtctgtcaagaatcactgtccttcatttactgatattcagcatcttaaaacaacactgtttgaaatatgttgcccagattttagttgtttttaacagttgactatatttggtctctatattccatattgaccggaagcaaatatgttcactaggttttgatttgtaagttgtaaaaaacacgtaataaaattaaaatatatgttgtctttagacaatttgttaaaaactaactttggtaccatatgacttaatcaggcttaaaacttgaaatatatgcttatttgttaaaataaaaaacagtttaatttgtttgagacatttaatttgtttggcatgatcatttcttttctcataaaatatacattagtgcttaagaattttaagaggtatagtctttccttttataatggtggttgtttttaaaataaatctgttatttctgttacatgaatacagatactccttgacttatggtggagttacatcgcagaaacccatcgtaagttgaaaatactgtaagtcaaaaatgcacttaatacacctaacttacaaacattacacctttgcatagcctatcataaacatcctcggaacacttgcattaatatttgggcaaaattatctaacacaaaggctattttataataaagtgctgaatatctcatgcaatttattgaatagtgaactgaaagtaaacaacagaatgattttatgggtactctaagtatgtttttaaatgtgtatcactgcatgcagatgacattcatactattgtaaagtcaaaaaaaataaattgaaccatcgtaactgaggaagtctgcagtttatgataatgtatggattttggaaaactgttgcaaatatgttaaaattaatttgtactaatctcttgcacatttgtatattaattgattaaatgcttcacctatagtttttttcacagaattcatttcatttaaaattttaagctcaactttgaaaattataaactgtgggttgaaatattataaataatactttttgcttattttctttaaaaatataaacctatatcaaaacatatacatgatatatgtgtgtttttatgtatagacactctgaatgcaacacatatttttattttacacatcttttcttttattccacaaatcttgtattaatactaaatatcagttgaattcccaagatacttttttatgtgcctgcaaataagaattatcctacctgatcttttcaaagtaactttaccaatgaaataaatttgactgtgtttaaacatttccaatcttgagagcttcagaaatctcgtgacagaatgtgtccatccatttagtatttggcaagttactatttccaagtttcttgtttcccttctgagacacatcaggcaaatgagcttttactttgaattaaacagattgttttgtagatagtgcttctattgtgttaataaaaagtttcattagtctatccctagtgactaaatgtggcaattagtagcaacagtattgggtgggtgactgtgtgtgtgtgcgtgtagtatatatttgtgagctttaaagctatttgtttcaataaagatgacagcatccaagatccccaaagtttccattctggaagtattttaacaatacagtttctaaaacaacctgctaacttttctgttaatccacctattgttttctgacatgagaaatgctgcactcacataaattgaactgaaaatgtttaagttcttccttaaagtgagaaactagcttcccatcaaaatcatcagcataataaaaatattatatcatgagatgaaagtaattcagcaactaatattctctaaagagttaggccaagatgtatttgacacataatatgctagacattttggagaaagcaatacagttcttgacttaaccagagtatagctaggcaccttcagtgctcaacttcactgaaatatcacccatctatcaagaaacctgacgcatagtgggcaaagtttaatatgtttcagatatggaagggaatctaaagtagtgagggggcaagtgcaagttataagacacagaatgaatattgttttgtgtcactaagtgaaaagccaaatgtacactatgagatttacgacataagccaaaaacaagaaaacatttgcagtcctgaacatcaatattttcttcaactatgtgagccaatgaaagagaaaccctgaagaaagatttatacaaaattcacagcttaaaaggggccaatggtaatagtaatcttttaaataactctatacaagataacaattcaggtgaaagacaggccatgggcatagaccacacattctatctctgtcaccaaatgagttagttttctaccccgatatagttatcttaggttatgtatacacaataatttagcaaagaagggagtggccattaagggaaaaaatctatagctaggaagaaattttctcggataaaaggtcctgacagtagctttaaaaatacaaaactgataactgctatcactctgctaactttctgttactacagctgttttgatagatatgtaactatcttcagctatgaaacataaattttatgtcaagcaaggtaatgtctgttagtgacaacctagccatctttcaaaaactgttgctatagcgcaggcaatgaaatgtttaactctagtaactcttttaagtgatatggtcaaggcaactcagtggggtatgtccaaggggcttgcaactttcatagcaaccatcacttgatggcatgttacctcctcattcatgagaaactgtggacagagacagaaaaatcaaggaaactggagcaaagtaaacctgtgttctccagactgcttaataggggcggtagcatagcattttttgttttgttttgttttgttttcagctttggcattaattacagagataaagagaggaaaactattacagatacattagggttcttcattttagcagttgtgttttctgaatacaataggcaacgagccatatgtttaaataccgtaacctaatgacccctttgcacactcaaaccccttacaggagggggagcgtgcagactggcaggtacatgagctgagacaagtgctctggggctccagccccatggtagcatctagaggtgagtgcctgcgactcccaaagcccacgtggatgtggcctgtcttaaccgtgtgctcttttagctttgccttccacagacggcttaagtgttcaccagctcagtgccctcttggtacccaggtctttgtccgatatccaggaagaatcaggtcacacatgaatgtggagatggtgaacgcaggggttttactgagtggtggaggtggcgctcatcaggatggatggggagctggaaggggatggagctgggaagatgatcttccctaggaatttggctgtccggtggccgatctcctctctgaccgccaacagccaaactcctctcagcattcagatgctctttctcttctttctgctgagccgctctgctgttctccggctcttctgtttgtctccttctcatctgcttctagagcttggggtctggggtttatgtgagtataggatgggggtcacgacaggccaaaaggtaacttttgggaacaaaaacaagaatgtctgttctcacttagggccacaggtttccaggattgaaggccgggcctttgccagggaactaccctcttcaacccagtatttctgtgtccggtccatatcaattgctgggagaattaatttgaatttaatagcttttctgaagcctgtgagtccttctagtgagtcagtgagccttcgtgttgtattgagaatccctgacaccctatgcaattttaatttttttcttctacacaattgaaaattttaattacttttaaaggaatgaggttttacatttattcattcattaataaattattattgagtgtcttctatgtatcagtcttattttaggttgtagaaataccacaaagtatgaaataaaatttctatctttaatatccattcaaaacatagaataaaaaaggaaacaaattaaaataatattctaatataatttgcattttaccaaataaatagactttgtgtgaagaatatatattaaagctattggagagaactgatcccccttaaggaattttttttttgtatagcagattatctgaaggtgtaatatcagggctttcttccctgctaggagtttgatttcaattaatgcaagtatcagatgtaaagaagggcaatagcaagtgataaagacttacactcaagtgctactctattatacttggggatgaatatttcatggtcaattctggaaggggttaagtatagaaattgaacagtggtaagtggctgcctcaggagaaaaggtagcagtaattacctctgaagggaagaagattcaataaacaaggatgttggagagctttggaaataagctttacatatcacaaactatctattagtggaatgtgcctagtaaaaaagaataaaaaatgtaatttccacaggattctctatgcagaaacaaaatacaaaaagggaaaaaaaatggccttttcttcccacccactcagggtaatttcttaagtcttttatgatctgataagaaatggaggccgggcgcggtggctcacgcctgtaatcccagcactttgggaggccgaggcgggtggatcatgaggtcaggagatcgagaccatcctggctaacacggtgaaaccccgtctctactaaaaatacaaaaaattagccgggcgcggtggcgggcgcctgtagtcccagctactcgggaggctgaggcaggagaatggcgtgaacccgggaggcggagcttgcagtgagccgagattgcgccactgcagtccgcagtccggcctgggcgacagagcgagactccgtctcaaaaaaaaaaaaaaaaaaaaaaaaagaaataaatttctagtgttttttgttgttttagccaagcaatctgtggcattttcttatgaccatcctggctaactaatacaattattaaacaattaatctttctataaaaattatgcttaatgttctattatgatgattaaagaatactctaccaaagagtgttatatttaatgtaaaaaagtaagacatacacaaatataaagaacaaaagtaaactaaggtactctctcactccagagatccaaaaatctattgtaaatttcaatatgacggtggaagccccagtgtattttgttcctaaagaaagagagatttggggcattttggaacatttcataactgtgggccaaataggaatgtgactagaccatgtgaaaaataacaataaagaagtcatcatgttttagaatcttggaacagagctaaagtagtatacaaatgaaaacagagcataaaatacatgttctacaagaatataagccttgtataagaaaattagattaatggaatgtctgactccagtaaacactcaaaaaagaaacagtgacataagctataggaaagaaaatgaaagaggtagtagaacatatggatgaataagattatagtaaaatagcaaaactataaaaagttttatttttagagtaaattattaacatgtgtaaactaacaattaatatgcattggaagggaaaaattaagaaggcataacttgctccagaagagaaagatcacctaaaaaggattgagtgaaataaaaaaaaatgaaaaacaaattgctgaagaggctcatgaaacatgttcaccgtgcatcaattaccaacttgtctgagtccagtgacactggagaccccccaacacacagaaggaaataggaccagtttactggaacacaggtcagtagtacacatacaaactaaagtgccaagaaaaaaatatgagaacaattcagaaacattgcaagaggcatgaggagcatgctgaataaatctgactcgtgtatttgctatttaagaagagaggacagggactacggagcaaaagcaatgtttgaaaagataatgaataagaatgttctaaaactcattaaagtcagaaactcacatactgaagaattctgcaaacttcaagcaaggtaaataaacagaaaaacacatttaggtccaatgtggtaagaatgcataaaataagtacaaagaaaaacatctaaaagcctgagataaaaggcagattacaatgaaaagataaacaatcaaatgaaccatgactttattacaagaaattatgatttcaatgccactcagtcatatatcaccaggaacacacctgtagttgaacaaattgggtttattgttcttttcagtgagcaaggacactcatcatgggaagtcagctggcttttcagtagtgagtattagggaggactttgatgggatgattttggagaccatccaaggaagcaggcactcactatgcattgggtgctcttaggaagtaaggaccattctatgactggttatttcagtaaatcttacctaggaagaggaacgcctagaatgaaaatagagcttcaatttgcaaagcagagcagtcatattagccagtagaggattgtgtttggtattttgtgggttgcacagtgactttggttttgcccacgctcagacacaaaattataaagtgagctcttgtgtctcaccttcccatggctgtagagtgggctttgctggtggtggtgtggggtgtgagtgcgtgcatctaacaggaagacagcaaagcctagttgcttccttgccaggccagccttaaacgacactgagtctaacagtaagtgcagaccagttccagatgccaccactgcttttgaaaattgtaaaatatttgagtgtcaccttcaaagtgtgaagaaacaaaaactggaaatccagtattccaaactaatgaaagtatctttcaaaattaaagaaggctgaagacattctcagacagacaaaaaactttgggagcactgtcttcattgggtctgccctgaaattactaaaaagaacatccatcaggtagaagaaaaatgattcaaaattactaatcaaggataaagaaagaattaaatgtaatataaaagataaagctacagatacatctaaataaatactgactgtattaaaataagaatactaatgtctggtggagtgtttgtgtgtgtacatatatatatgtatttgtgtgtgtatatatatgtatacttatgtatatatatatacatgtgtatatacatgtgtttatatatatatacatgtatatatgtgtatatatacatatacttaatatctagtgtggcaaaagtgaaagtaatacaattaaaatattccaagagtcttttattttttggaaggaagaaaaagtcctaatttgttttagactaaggtaagttaggataaactttatgtctactaaaataataaagaaatagcaatagtctaattatcacattaataaaattgcaaaagaaatgataaataattgattaggaggaacaaattcaagagatatattattcaacatggggactatagttaataataatataaaaatgaaagtaatagattaatcaaaaagagacaagaaagtagaaaaaaagtaacatagaaaagtggcctcagtggaaaaagaatagtaagttggtattaatcatgatattaaaaacaaatgtatcacatgctgaaattaaaaggcaaagatttacatatatacacatatacataaatcatttctgttcgactttcaaaataaggatgttgtaagtaaaaagtatataaaaaggtatttatgattagtaacctaaggaaatgggtgcctttatactaaagcaacctaacgtcttcttgaaaccaagaagcacagctagagttaaggtaggacatttcacaataatgaatcaattcattgtggaaatattacaattttatactgctatgtacataacatagcttcgtagccttaaaatcttaaagaaattcaaagcagctaacacaaaatagtaagaaaagcagactaaaaatgtcagtaaggaaatagaaaattggaatgtcattaagaaatgtaagacaataatgtcaaaagtgaacatatgactccagcattcacgcttgtcaactgcacaaggagcacttagcaaacttttatgctgaacagcaggctataaagaaaacttagtaatgttgaagaactgaaatcataatgagtaggttttcttaccattatggaattaatccagaaattaagtacaaaacaataacttttaaaattcgaaaatgtttagtaattagcaatgcatttaaacataaaacatgtatcataaaggaatgattaaggtaggacatatattccactgagtgcatgcacacaaaaaacagatacttaaggatgtgaaagtcaccgaacacatccaaaagagaaacatttgcagacattcatgcatctatgataaaagaaaagctgaaaatcaatgattcaagcattttgttcaaagaagagagttgtaatcttaaataaaatagcagataatgaaatataaaatatagtatggataattaaatcaaaggtgggtcttttgaaaagactaatacatactcgtcaaaatgctgacggtgtgggttaataaaatgaaaaataaatgcacaacactccctgccctaaagtagtctagaggcataatttatcagtaccagtaataaaaacagagaatatcactttaaaatttatggtcatcaaaagaacaataagagaagggaataaacacatgtatgctaaaaattagtgaaatgaggccgggtacatggttcacacctataatctcaacactgtgggaggcccaggtaggtggagcacatgaggccaggagttcgagaccagtctggccaacatggcgaaaccctgactctactaaaaatacaaaaattagcaatgcacggtggtgcacaactgtagtctcagctactagggaggctgaggcaggagaatcgcttgaacccgggaggcagaggttgcagtgagccaagattgccccactgcactccagcctgggtgacagagtgagactctatcacaaataataataataaaatgaaattaatcctcatataaaaatgaacgcagtgacagaaatgacaaaatgctgcatcttgatcaagctgggattattctagaaatgcaagaaggatttagcattcatatatcaaccaatataatatgccatattcacaaaaggtaagtaaacaatagcagaatagaagctaagacaaatagaaaacttctgttatattttcaataaaggcagaaacaatccatttcataaaattcataatatcataatatttcttatccacctaaagattgaagaaacttcctatttaagagcttcagtttttttttttttttttaacggagtctcgctctgtcgcccaggctggagtgcagtggcgcgatctcggctcacttcaacctccgcttccgggttcacgtcattctcctgcctcggcctcctgagtagctgggactataggcacccgccaccacacctggctaatcttttgtattttttagtagagacggggtttcgccctgttagccaggatggtctggatctcctgacctcgtgacccgcccgcctcagcctcccaaagtgttgggattacaggcgtgagccacggcgccccgccagagcttcagtttttattagagccaaggtgaggaaaaaaagaggcaaaaaaaaaaaaaaaaaaaaaaaaaaaaatcctacggtaaatatcagattaaattaaaacaacttaaaaactttccttgcaagatcagaaataacacattgctgtccactgttactacttctgttctcctatgtaatattgtagtgaagcctcagctagtttaataaagcaaataaataaatgataaataaatatcaaatagaaatatataaatagtattacttgaaagttacataaatataaaataggatattaaaaatctacagataggctattagaatttctaaatttagcagacttactggatgcaagtaaatatttttaaaaactgtgtttctaaacactgtaccaacaacagtttaagaaaaaaatatgactattacttccaataacatcaaaaacatcccattcctaggaataagttgaatggaagagctacaaaatctctatgccaaaaataataaaaataagggagtaaaattaaagaaccaaatcaatgtaaagactatgttcattattgaaagactcagtatcccaaaggacagaattttacccatgttgttcttcagatttcatgaaatcccaatcaacatttcaacatgtgtgtttgtatgtgtgtgtgtgtgtgtgtgtaaattaacaagatgatttgtatggaaatacagtgctaagaatagctaagaaaatctaaaagaaagaacagaataaagaactttcacttccagactttaatacttactagaaagatcagtaaagtgacagtgtgatactagtgtaagcataaacatttaagccaccaaaattgaatgacaagcccccaaacagaacgacacatgtacagagtcttgatttataattaaggcagcacaacaggacactcaggaaagattagactttccaataaaccttgctgagtaaactggttagccatattgggaaaacaaagcaaaagagaacaagatacgtagtttgcctaactgtacaccctcaaacacttagattacagatatcattgtagaagataaaattatataaatattttggaatataatatagaaaaatatgtttatgcctttgccaagactaaacaccaggagcaataaaaataaagaagaataaaacataaagagcaataaaaataaagaaaaatttaaaaaaaagaaaaaataaagagagctataaaaataaagaaaaagattggtaaatttagcctttaaaatttaaaacaacttttcataaaaaaactatctacacaaaagaacagaatatatgtatagtaccatacctagcaaaggacttgtttctagcatataaaaacccctttaaataaccaagaaatagaaatgtggtagagcaaatggagagacattggaaaaaggacttcagctaaaacgctttgtagattaacaaagacatacgaaaagctgcaccacctggtcatcaggaaaatgcaaaataaaacaacagtgaagtacgaacacatacatcagtgcaggtaatacattcttttttcaaagactgaaacaccagttttaagtgaggacctgaagtaagcagagctcttatacactgctgaggggagtatcaatttggaggatttttgacagtatttagtgtattgaacgtgcatatccccagccatcccttaccagctttattgtacccattgatttcactgggatgactcacctgtgcttgcacacagtggctgtgccctaggaaccacacatggtccttcctcttgtttctttactcttaataagtaactcttacttgctttcaaatactcttctaatattcttacataaaatgttttaagacaggttggaaacatttgtcataaattctcattactggcagggggtggtggctcaagcttataatcaaacactttgggaggctcaaccaaaaggatcatttgagaccagcctgggcaacatagacagtccctgtctccacaaaaataaataaacaaatacataatcaacatcttatgctaaatacaacaaatcagaaaacagaccttattttcatattggagatttatcagaaaaactgttctagctaagatagtgaggcagcatgcctattagttaagagaaaaagcctcatagtgaagttccttggagatcaaatcctcattctactatgttctgagtcagtgaacctgggcaaattatttaatctaccagtgggaactcatggctacattctacacagcctgcagcaaactgagaactttgtgtgatcctgtggcatgaacacataggtgtgttcatactgtggaatatatagagctgcatttttataatttctgtatttttctgaaataaaggtttattttaatattaaaaattgttttcaacttaaggatttcatagattttcataaagtttactgcactaaactccagtgctgagcatcgctcagtgcttcagctcaggtgtgaaaatctaggaagaagaacctgacctgattggttgcgcacaatttggggcaattacatttgcagttccaatttcccactgggtaggggagggctagtataattggcagtactaacagaatcttctaacaggtgcatggtagatcagccccctaagttatctgtgatggtaataatgttgccaagaatcaatactaggcatggaaaatgaatgaaaatcaagagatgtctacaaccctaaatgttcatcaacaggcagtgtttaaattaattattttatatctactctatgttgtattagaaaaaaggtatacatggcaaatagtgacaaagaatcacaccagattcaggggaagatgaaatgtacattttatggaagtattcataggcagaaacatcagtgtagtccacagctctctgatgtctcagctttccttgaaagtgacataccagataccactgtggaaattgctccaagggaaggatccaaccttcctaccactatataaatctatagcaaggtgagaagagcccatggcacatcccttgagtagttcattgtataacaaaggaacatctctggacagagatatgggcttgttaatctagagttcaggtaccagctagaggtctctggttcttctgctgtgataattctgcagatctatcaaattagacaagaggagaaaaaattagcctctggggacatccaggtttgtctctcctcagactgtcctctgtcccttgaggacttattggatacatgatcctacattccagtaaatgtcaggttgtaacaatttctacaacatggtctgtaagtggaaaaatcaatatattttcttgcagctgggtccagtacactaagtaactttcgtaccaacattgctacaagttccctttatatgcaaatgtctaatggcactccactacctgtaatctctctttttccaacttttttcctcacccatggatatatattttatacatctttatttaatcataaattctcctttatctttcccatatttaacttcattttaatattaaagtgatgttatatttatgaatgttttatatgttgcataatatcacgatctcatgctatcctaaaacgtgaaacgtttttgccttttctcaaatagtttgagctttggctccaaaatattgtcattatttttaaactgttttccagtttttcggtagtttaaaaatattttttatgatcaattacatagcttttaattgaaatgctgatggaattgaaatataaatcctttatttttcaaaatgttgtatggtgtaaaacatcatggggtcatagaaacaacgaacaaatgtgacatttaaaatattttatttcatgtttaccatagcacaatataacaataataaccaaaaataacaacaataataaaatataatattttaattgatatttactcttttgggcattattgtaagggttttagttcaacctctcatttaaacttcaaaagacctacctgaacatattattataatcatttaacaggtaggtgaactaataactgaaacaaagagattaaacaatttgcctaagttcacttaattggaacatattagaaagagggtgttaccccaactagcctttctccaacacctcttctcttaactaacattgcccaaaagataaccatgttctctaaatagtagaaaagagagctttattggtgacatcagtttgcacactgggaagtgaaagcctccatcatgggttaaaagtgctctgtattttttttttatttccaacttttattttaagttcaggggtacatgtgcaggatgtggaggtttgttacataggtaaatgtgtgccattgtggtttactgagtagatcatcccatcacctaggtattaagcccagcatccactagctattcttcttaatactctccctccttccaccctcaaccctccaacaggtcccagtgtgtgttattctcccaaatgtgtccgtatgttctcataattcagttcccatttacaagtgagaacatgtggtgtttggttttctgttcctgtgtgagtttgctgggtgctgtctcttcaaaacgggttggtttcatgcctcacagaacctgtagcacacagtagagtcatacatattcagcaggtttgaggtaaaagctatagatatttatgaggtgagccaagcacacgtggaatggatgaacatatatgtaacatatatcccatgtttactttggggcaggttttagtattaaaatatggtggactttggctatttaaaccaaaaggtgaagtggagcacacaaagacagtttgtgcacagcctctgtaagctgctggaatgggcttaagacctgcagttgcttctcaggaaagaatgtctgtaaggctggtcatctctccagtcagagttgtagtggtccaggttgtaagtcagaatcaggagaggtctactaaattgcatgacagctcttatcattagggtgtttagcaagagagtgtttttgtcttgtagctgtaggaacttagagagttgccatgccagcagacacctgagccctcaaactgtagagaactttagtttctttaacttcagagtccaccttggttgataaaagggcatctgtttttgtctctcagatctcactaatatgcaacctaccttcataactaccttagctaccacgatgtttctgctaaagaggaatagacaagacttgttgaagtaggaaaagaagaggaatgaggagaacggaatgtgtagttcccagggtagtcaccatagtcgtgtcaagaaggaacatcatatcaaatcagtagatccgataaaatcaaagcttagttgggggatgagtccaagaagacgtctactgaccgttatctttctctctttcaaaaatgttcttaaatctggtccaattttcatgtcaattgaaaaaagaaaggatagcagaaaacatttttttttctaaaaatgaaaacaataaccaaatggaacattatatgttggcagaaatggggtaaatagagttaaaaaaaatggacaaaacacacacacacacacacacacacacactcacacacacacacaaactgagaattgagatgcttgactgccagaagggaaataacgtcctaggagacaaacaggcagaacatcagacagggggaagtggagagaagcctgtgggcagagaagagagcctgtgttcccttgtagaagagagagaataagaagacagaaaaattagacattacctgatgtgaattaaaaaagaaaggaaaggtaggccaggtgcggtggctcatgcctgtaatcccagcactttgggaggccaaggctggttgatcacgaggtcaagggatcaagaccatcccgtccaacatggtgaaaccctgcctctattaaacatacaaaaattagctgggtgtggtggcgggtgcctgtagtcccagctactcaggaggctgaggcaggagaatcgcttgaactcgggaggcggaggttgcagtgagccgagatcgcaccactgtactccagcctggcaacaaaatgagactccatctcaaaaaaagaaaaaaacaaaacaaaaaagagagagagaagaaaaaaaggaaaggaaaggtaagggaaaagtgatgtaactggaattctaaaagatggcaaaagtgaagggaatatattcaaaaatccaaatgaaagcataattaggtatagcaaatgaattaataagtaatttgcacagtaaatttgaaataattttaccagcaaatttaactatagactgacctatataaggtgataaaacacatgctagataataaacaaaggtaaattatagataggcaacttcaataggatatgtgaatggcatgattcaataagagcttaattttcaaacagtaagcttaatttttgaattgtgagaaatgtacataacataaaatttaccattttaaccatttcaagtgtttagtttagtggcattaaatgcattcacagtgttgcacaatcatcaccaccatccttctccataaatctttgcatcttgtaaattttaagttttataagctactaagtttaattttttaaaaatgtgtgcagtatgcaaacctctatcatttgaggattgcaactaaaatccccaaaccttaattaactagaccaaattcatttatttatataatttttaaatttactctccatgtgagtaaagctgacttaattctcttcaaatagcttttttttagaaagagaaaagaagtcattattactcttattttaaaataataatgaaaaatttgaagaactatggtaaaattggtgctgggttatctcaatcgctatctgaaaaaatattttcatatgtctctgctgattatcaagttattcaaaataattaaaatacagcagctatcagtgaagttgctacacatttggccccatcaacttttccaagaactttaaaggcaacgtcatggacttttaatcaaatagtatggatgacttattaatcttttctgtacatggggcttttctgattactagaagacttcattcttttcagatcctaacctcagtgaagctcaatttaatctagaattacctaaatatatctttacattttggactggatttatctgatgttatcacttaatgctgttttttcacaccaaaatcagtaaattcatctcaaggagcagaattttgttgatattttaatgaatataggaatatttgacttggaaatttttaattttgaaggggtgtgaatgctgtttacattcaaatgtgacatttaaaatattttatttcatattcacccatattgtaatttgaggatgctttccagaacttctgccatagcacaatataaaaataataaccaagaatgacaatgataataaaaaataatattttaattgatatttacatttttgggctttattgtaaaggttttagttcaacctctgatttaaatttcaaaaatctacctgaacatattattataatcatttaacaggtaagtgaactaataactgaaacacagattaaacaatttgctcaaggtcacttctcattggaacatattagaaacaggatgtgaccccaagacacattacaacattatggaagatgctttaacataagcagtaaacatgatcattatcccatattgtgactttcatgttacaattaccatacatacaaatcctaggaatttgagtctctgttttattttttgaattagagcctttgttttattgttgaatttataaatataacaacttgtctgagcttaacacttttacttattgaaactacattaataaaacatttatagcacttgggaaggaagcactgtgtgaaattaccatttaccttaattttaagtataaaaatacaatcatgttaataacttgtactttgcagtaagtgtgatatgccaatatcaaaattagtacattgtgtcaaaaagaaaatgtattcactgccagcttaagagcctacaggaagggagaagaaaacatttttacataagatgctatgtaaagccattttccactgtctgaatcataaatcacaggactaacctaaaataaagaaatagatttgattagcattaagggatcactacatcaagttattaaaattttgcaaagtgccaggttgtatatggattaattttagctattctaagacttatgagttatgcttgaaaaattaaatctaaaaatgtattttaaaaagtatgcaggaaattttcagggttacatggtattaaccactagtgctaattagaaaaatgagatattggccttcttactagttatacatgaccctataagaaaatcatcgaaatatgcacaaatatattaaataaatgttctgttataaatactataatcctaagtaatgacagattaataaatgctataatcctaagtaattacagattttcaactttatatattttagacttattattaaagtataatacacatgtaggaaagcacacatgtacatgtatataaataaatatgtagtccttcaaaattacaaaatttccatggttaatgataaaaacttatttaaaatattatgatgtaatttaagtatatattcattccttattaacatagaagatacatattctcttttgttcatgaaaaatttacctaaataaaaatataaagtaaaaacagattatagttaataatgtgtaaaacttaaaaaatagtaatttttaaatatcttgataataattacttttataagtaaactatatacacatagatttcagtttttccacacagccttcaagtggacctcattgtgtaacatggacccatatgagagaccatgatgtgtgtatgtctgactagcaagattcttttcagtttattgtctttttgaagtttgttgtattgcgtttcacatctgtcaagacatctgtatcctccagttgatattctgaatttatagttctgtagttacagaatttcttttttattttaatggcattatcatcattaatactcctgtaaggaaatattccacttgttgtttttcaaaagaacatatgttctcatacatattttcataaacaacttactttattaaacttctgtttttgtttcactgagaaaatcattatttgaaattcttaccatcatgctggaaaatcttttgtacaatacagctgttgaagtgacaacttcatattcacaagtgtttgtaattcctataaaataaggaggaatgatccatgtttgattaatgttgtaatataaagctacctgtaagaaacaatataaaggacattttgatatttgccaaaattgtactgtttaaatttcttttaaataccctaagcttgtcattttaaaataattaagaaaagattgaaaatttattttgccattatttatttcttcctcatttgtatattaattataagaaattacaacatcttaattaaaatattacgtatctactaagtactaactcttcatgtagagtatattggcacatattcattttctcatttttgcaattagatattttccattatataattttttttaaatgcataaccaaaacaaaatattctgtataacaattatatctgatgaagtcagcttataattgtttttaacaataatatatttggatttgacacataatgtttagtttttatagctaaacattagtattttaaagtttaagatatattaatattttaattttcactgctattttccttgaataataacatccattaccttagatgttaccaactattaccatcaaccagtgcttctgcagtataacagtattatagcagtttcaattcaaagtaaagctaatgttctatcaatcaaaggagatgctgtaaaaaactaacatttgtttatactcatcacagaaaatataatcagtagagtttaatatgttattaaattcttattctttgaacacaagtaatctatgcattatgtacactgaaccttccaattaactctcatatttgatttatcacagagctcagtagtttaactcttttgcttataactcactgcaaataaatgtcttttgacattaacagagaccatggattgtgtataagaaatgaacacacatggtctatttttgttttgtttaaatccttttcctcctattgtcattctttattttgtcaacttttttattacactggtagctactatcttttgaatgtatttcacacatcttaatttgtaaggggtagcaaacctcattaattacattaaatagttaaataataaaactgatatttgttaaacactgctatatactggggactgtgttggattacttattctcccattaaattaattaatattttttaaaatccgggaagttttgactgtaattgagagttgagagtcacgtgggtttaccatggcttcctttgcaccatgatgatcattgagagagtaacagtgatattagaacaaagaaaatctaagtgaagtgatatgatacagaaacgcgtcatgtaattttgaaagggatggatactatgcattatattatatagtgagctgaagtacataaattttaaactaagaaaatggaatgccttggacaatgacactaaacatcggctgagtgagaataagtggcctaccctgtagtgtatgtggccgtaaaattgatttttccattttgtgcaaaagcttatcactaagcatgagtttcagggacaaaactataagtaataacattggagcattaatctgctatcattctttttatagagagctgatagaattggccatattttggtatttctactaaaatataatttctgctgataaaactataactattcaccattgtaaaattccaattagaaagattttatgttagaaaacatatgctagaaataaatataaataatgtctagaaatatgtagaacgttatctatgcagaaatatgtatatagagagtatacagttgccccttgaacaacatgaatttgaactgtgcacattcacttatacatgagttttcttctgcctctgccacccctgagacagcaagaccaaccccacttcctcttttccctcatcctactcagtgtgaagatgatgagggtgaacccctttatataaaccacttccatcgaatgaatattcaatgtattttctctttcttgtgattttcttagtaacatacatacacacacataataatatacatacacacacatttctaaacactgaagaaaagatcaagcccatttcgttataattggatttctttcctaattacataataaaataaaggctagtgatttgatgtagcattcaccaaattattatttgaagcaatggaaagtacagttatgaaaatacagttttagcacatttcttagtgagagaaaaatcagaataacatgcaaggataatgaaaagaggattaccattaatgaaaatgaatttataacaatactttttaatttagtgtgagatccctaaaattgtgtggctactaaaaacatgactggtgaaaatgttgatgaggagttttttaggttttgggagagaatgctttaccaattgaaaattctacagtttggatatttgttcccaaaaccttaggttgaaatttgatcccgggtgttggaggtggaaccttgtgggaggtttgtgacagatcccccatgaatagcttgatgcctttctcacagtaagaggtgtgttctcattctatcacttcccttgagaacaggttgttaaagagagcctggcacctccctgctctctctctctcttgctttctctctcaccatatgatctctgcacatgctggcttaaacatcctgccatgagtgagagcaacctgaggctttcacctgatgtccaatcttctagcctatagaatacagaaaagccaaataaacttttctttgtaaattaactagcctcaggtatttttttttatagcagcactaaacatactaagacagaaagcaacggaaagaccgattagttttgaaatttgttaccagatgtttataacattataaacatagaatctaagaattaagatattctattaactcaggtattccttcaaatattgccacaacttaaaattctatttgatttgtttcccatgtactgaggctgaaccattcacacacccacccacccacacacacactcaccaacgtgcctacacacacacacacatactttataatgtattatggctataaaatatggctagaagtcacctaaaccttacaatgcaaatttatttacaaaaattcatcaaacaataagtaattactaagaaaatcagaaaatttctgtttgtataagacttttacaaaaagcatttatacattaagaattaaaaaagtaattttcaactaaaacatttaaccacatattcaaaaattaaaaagcttgactttgtatttatattataattgtactaagtatgagaaattatcattgtgttgttaatttgcagtatttaggtgatttctgtagggacttgtagtagaaaaagcttaaagatactactactattgtcagtgctggttttgacaagtcaacgtggatgtctctccatccctctatgaattctagggattaatatagggctttggttcccttcttgtcaatcagtttctcatctttctctatcaataagttcaactttattaagaaatagatttgtttcctaaaacatgtgcccttttgggattttaattatttgtcttatttcatttctgtcaattctcttcaatcttcattgttgaccattttttttaacactaattaggtccatagattgtatagaaatagtttatattgcatatagtttttaaaatatttgacactttctcctgaacacatttctgaaaatattgatttcaatatagtccagagaactcatttcacttgccagccaagtatattatttaagaattcaatattttctactcttgtatttacacaaagtatatcttagaaaacatcaaaagtctgattattatgggcactcatctctaaagaaggctcagatctagaattatttattttattatattcaattcctaagttccaaaaattaaaactgaattagttcttaaattataaaataaaatagatttattttcaattgggaataatgttctgaacctcaaatattttgctttatttgatattgtgattaaataatagtcactgagttagtttttaatgtatgtatgaatatcttgatacctatttttatatttaaaaaatacattatttttataaatattgttaactcattttttctttcatttaccaaatatttattgaccacttataatgtaccagttattttttctctgtatagaggtaatagcagtaaataagataagccttgctactttcatatttttcctatgaagttttaaatattttatgattagtacatttttgtattatattactcttattacagtcaaggttaacttagggtaattatacataaatttctatttttttaacttatatttctgtttcctttaaatgtattctctttcacaatacatcttttaaaaatgtataccaaatgaatgtagttttcaaagccaagcaaagaacaacctcattgcatatacctacaaaattaatagtggcacaaaaattatgcgcagccagcaaaactagcaaaattaatgtgctgattctgaccagatttgcagaaatgcaaatattgcagttttcatctcatatagtttgaagagataaactttaagagcaactttttttctttataaagtaataataagtttaaataatttttgataccaaaatatttataatggcaaaatatgaagacactatttgtctgagccttagtgtctccctcaggaacagatactttcccaaatctgtttgaataggaaaaaatatatatgtatatatttatttatttgtttataggactttattgtccacattatttatttacgaatactactgaacttataagtaggagcatgtagttttcaacaattcatttaacagtttaactacttatctctaattactatatgtttgtgtatgtaacgggatctaatgtgaaagctaattacaaattagaacttaaaatatgatgtcctaaacatgcagtaagaatattttttagaaatcttcttatctataataaagaaataaatcaaatagctagactagacttcatgattagtagaataagaaggaatggggtactaaaaaataaagatttggcttcaactaagaaaaaaggaaagaagtaatctcctttaaaatttatagtcatacagaaggcacttccgaacctgtgggggaaggggcataagaaagaaccggatgcttgtatgctcccctcccctcccctcccctcccttcccttcccctctcctcccctcctctcctctcctctcctctcttctctttttctttttaagacagagtcctgctctctagcccaggctagagtgcagtggtgcgatctcggctcactgcaacctccacctccctgcttcaagtaattctcctgcctcagcctctcacgtagctgaattacaggcgccagcttccacgcctgagccaccatacctgtctgcttttattttcatagttattttcatagtttcacagagtcctatataactttatacacaaagagacttcttaaatatgaatgataaactggtaaaagtcaagaaaacataaatattctaagaaaattttacccagaagaggtgtaagagcaataacatggaacatatatgacataaaattaaacaccaagaggtaacagttggccaggtgcagtggctcaagcctgtaatcccagcactttgggaggctgaggtgggcggatcacgacgtcagaagatcgagactatcctggctaacatggtgaaactccgtctctactaaaaatacaaaaaaattagccgggcgtggtggcggatgcctgtagtcccagctactcgggaggctgaggcaggagaatggtgtgaacccacgaggctgagcttccagtgagccgagattgcgccactgcactccagcctgggcgacagagccagacttcatctcacaaaaaaaaaaaaaaaaaaaaaaagtaagagtttctctttctctgaaaatgaaatttgagagctaagtaatttatatttggttttaatatcatggaatttggaggatcaagattagaagagttcttagctggtaggtggcagctgagatcgttgaataaataaaggttttgttagaattttctgcatagaaaattagctaaatgacagtagagatgtagagattaagatctctctatgtctacctcaagatacatcagatagagaaacagacagtcagatacatagatagatagatagatagatagatagatagatagatagaaacttaaacatatatgatagatggcagtggtggcccatctggagcagcctctgtggggattcctgctgcagctggggaggtgtggctggggctgcatgctccgtggagttggagggagcctggagcaggtgggagccctgaccctttccaagttggcaggtggagcgctgcactcctgggtacagctgcagccccctagctatggctgccaacttaaggacccaagcattcctgtgctcttaagggcctgggaagccccgcttccctcacaggctcagaagtgtctgctgccgctgccttgtctctccccaactcccagcacccactgtgatttcgtagcaaagttaaagccaagcatgggtgctgccccaacctggccaggtgtgtgcttgaggaggcactgacatgccagccccctgctgccttggctttctctggaatttgggcactgacaagcacaagagggcggtcaagggggtgctgaggatggctctgcacaggacttctggactcccttggcgcaaacagcctgggccccaagaatgacatgattaatggcagcaggaggcagaaacgttcctgtatggaaaggcatggatccttggtgaagccccaccttcaagccagggatggcctgaagcccagggccaagttgtcagttctggggaagtcagccacttatggtgctttttctgtgcccagtcttggctgcccatggaccaatcagcaggcacttcctaccttctgagcccataaaaacccccagacccagccagactcacacagaggggactaccagctgtgggaaggagctacccatttggcatctcctcagccagtcagaacgacctgcctgcagaaaggagctacccactgtgggtcttctgtctgctgagagctggacgctcatcaggatgacctgcctgtggaaaggagctacccactttgggtctcctgagaactgctctgccactcaatgaagctcctctacaccttgctcacccttcactccagttgtctgtatacctcattcttcctggatgtgggacaagaacttgggaactcctaaatggcaggactaaaagagctgtaacacaaacaggcctgaaacatgccccctgcttgccacattgtagatgaggagaaggagagaagagctttagcccttcagggtgcctatacctaggagctccccaagctagacctgtgacactctctttgggctctgcagttcctggcatctccaaacttccaggtgccactgcattctcctcatccagacatgggtgcccacagtggaagccacgtgcaatacatctggtcctggcacagcttggcacagaactggtacctgtgccagcacctgtagcttcccaccccgctgtgcacagtagccagaccatgcgcttgcttgcccacacactcctctccactacgtgcctggtgcacccttggcaggtgtgtgattctggctggtagcacaagccgagcatagcctgctgggatgagtggacataacaagcccaggggcacaatcaattactcaggcagacatgctgctggccaaagaggtttctagctcgtgaagtgacagtccaaggattctgtgacatgggtaacaaggaagatatggtgaaacggtaataatcacatatcagcgggccaaggtaggcattagggaaggaatcaaaatcttaggcagattaagtttaagaaactttctctgcaagaggtggaaatgtagagaaaaataaagttacctcaagagaatgattaaaaacaaaacaaaacataaactcacagttggtgaaattgtgcctctcattaagctaggtcatctattgcaaatgagaagtgttgcaaagagaaactaaagttgagaagagttgtaaagtatctgagagaaatttacagtttggtgactaaaacaagcctcttgtgtctttcgtagttgtgatttgaaatatcttctcccataagaacatgggaatgccaagaactattatataggatcaagaacttgtttatattgtgacttagaagaatgatatcaattttaaacatacagattggatttcataaaacctttaaaaaagttttttcttaaagaaatgattgaaccagaagtacccattctgggtaaaataaagcaaacatgcatcgacatttctctcccactacatctagaaaacactacatctagaaaacctagataaaatatgtggaataactatttgagatcttgctaacataaatataagtaggtagactcaggagaagcaccaaaattcaaaatactaaagaaatgtcagctaatttgactttttattgttctcgttccttgtgtattcactaccctggaactgagaggtgagcactgtgatacacacagagagagaaactctctagttctggcttgaggagttaaaaatggagacttctaggctcaaaaagatttgggaaaatttttcacgttttcactcacttatattccatgccccaggccaccttaagctgggagcaagatggcaacaaaagtagccaactgtagaggcagcaatgccataggagttgaaatttcttctgttagatggagccgtggctctcagagtggggtcaaacccattgattctttttcttcctttgtttttgtcttcaaaaattacaggacaatcagagaactgatggttttagccaggctggccaacatggtgaaaccccgtctctactaagaatacaaaaattagctggggatggtggtagacgcctataatcccagctacttgagaggctgaggcaggagaattgcttgaacctgggaggtgaaggttgcagtgagctgacatcatgccattgcactccagcctgggcaacagagcaagactctgtctcaaaaaaagaaaaaaaaaaaaagcagtggtggttttagcatatttaactttttcattagcctccagccaactagacagtgctaggaggcagcagagagaagagcttgggaaagcgaggctgtttatgaattcttaggctcaacacaagctgcccatgtgtgactatgtcaataattagaatacaatagacactgaaaactgtggtagcagatagacctccacacagaggtaaggctgaccactgggtagcatgcatggtggaagagagataacagcacagcctaaaaactgaattgccgttggaatcacagccacagaatagaaccatgacaatctccacttgcatgggaaaagataatggatacccacaaatagacagagatgttggcaataccttacacaaactttaattttttacaaaaatgtttgaccaagcaatcctgaaaacaaatgtcaaaatagaaaaagtaattaaaataggtataaagaggaaaaaaatttagaactgaaaaaatacaactaaattaaaaaataactcattaaataaactcagtaacagaaagtaggaggaatgagtcagtcaaattgaagagaagtcaacagaaagtattcaatttaacaacagagacaaaacatattgaataaaaatgagctatggaaccatagcaaatgctgtgaaatttgtgtctcagagtcccagaaggagaggaaaacaatgtaggactgaaaaaaagttaagtatgaggaaatatttctaagtttggcaaaaggcataatctcacatactccagaagctgaaggggcccaaaactgtacatgcagacacatcacaatcaaactggcgaaaatttaacaataagacagttttaaagacagccaaaggaaaatgacatattcgctgtaggattccaattatttgaatttctgtggactcatcatttaaaagtatgtaggccagaaggaattagcatagtattttaaagtactcaaagaaaaacaaaatagaactctcaacccataactctatatccagcacaaaatatttttcaggagtaaaggtaatttaaacattctctgctggaagaaaactcagagaatctttagtgagcagacttgttttaaagaattattacccagcaatcccattactgggtatatacacaaatgattataaatcattcttctataaagacacatgcacacatatgtttattgcagcactattgcaaagacttggaatcaacccaaatgcccatcattgatagactggataaagaaaatatggcacatatacaccaaggaatacaatacagccttaaaaaagaatgagttcatgtcctttgcagggacatggatgaagctggaaaccatcattctcagcaaactaacacaggaacagaaaaccaaacaccacatgttctcactaataagtgggagctgaacaatgagaacacatggacacagggaggggaacgtcacacactgggcctgtcgtgggtgaggtcaaggggatggaaagcattaggacaaatgcctaatgcatgtggggcttaaagcctagatgatgggttgataggtgcagcaaaccaccatggcacgtgtaaacctatataacaaaccaccacattcagcacatgtatcccagaacttaaagtaaaatttaaaaaaaataaaaattttaaaaaattaacagaagttcttcatacagaatagacatgataccagcaggaaacttgaatattaagaataaagaaagagaaaaaaatatgcatacagtggacttttgaataagacagaggctaaagaaactgaccccacacaaagttaaaaatctgcttatgatttttgactataccaaaacataactactgagtaacctactattgactggaagttttaccaataacataaagagttgattaactatttttgtgttaaatgtatcatatactgtattcttacaataaagtaagctagaaaaaagaaaatgttattaagaaaatcacagggaagatgaaacatttactattcattaagtggaagtggatcatcaaaaggtcttcatcctcacagtcttcacactgactaggcagaggaggaggaagaggaggggttggtctcgttgactcaggggtggcagaagtggaataggtggagaaggtggaaggggaggcaggagaggcaggcacacttggtgtaactttacaaaaatacattgcaatttctgtctgatttttttgccttttcatttatctaaatacgtttctatggagtactaaattttttaccgtttgctttaattttggtgcccatatcatagaagaatccatattgtaaaataaatcaaaagcagtcttgaaaatcaaaagccttctgccagattgtctaatgtcaacttgttttctggccctggttcctctatgtcttcttcaacttctggcactgttttggaagtacttgtctccatcaagtcatcttttgttaattcctctgctgtggtgtctaatagctttcaaatttctccatgattcatatcttgaaacttataacccagtcgttttttgccacatttacaatctctttcattatttcctcaattgactctgtcataaatcctgtgaattcacgcacaatatctggacacagctttctccagcaggaatttattgtttggggcttcatgtctttcgtagactttctataacaatgatgacatcttcagtgttgcaatccttccagattttcataatattctctctattaggattctcttccatatgattgacaagccttcactgtaaagtatcatgtgtaatgaaccttaaagttctatattaccttctgatctagaggctgaattagaaacattgtgtttgaggtcaagtagaccactttgttgactttggtgttgaactcatggggttctaggtggccaggggcattgtccaatatcaaaagagcttcagaaggcagtcctttactggcagggtacattctgacttcaggaacaaagcatcggtggaaccaatccagaaaacgtgttctggttgttgaggacttcttgttgtacaaccaaaagactggcagctggtatttaactttttctttcagcgctcagaaatttgcagctttatagataagggtagtcctaatcataatcctcactgcatttgaacaaagcagtagagttagcgtatcccgttctgccttaaatcctggtgctcacttctcttccttactaatacataccctttgtagaatttttttttcccccataataggtcacttacgtctgcattaataacctatgcaggcagatattcattcttctcagagattttcttaatggcatctgagaattctgtgcctcttggttggcagaaacttttcttgaaaagttttcttgaaaaaaattttaagccaaacctctttccaaaattatcaaactatcctttgctgacattaaatactccagctttagatctgtcactgaaaattctaaccagtgcagtcaggtaataaaaatgaattgcagattgcaaaacaaaaaataaaacagactctatttatacatcatgcctgtatatgtagaaaacccaaaagaatctacagaatacctccagaactaataagtgagttttgcaagactggaagatacacagtcaacacatgggcaaaacaaaccatcagaataattccaagtacagtaataattcaagaataaatggtttcagataatcttatttatttatttatttgtttatttttagagacagggtcttgctctgtcacccaggctggagtgcagtagcacaatcgaagcccactacagctcctgggctcaagtgatcctcagcacccccaagtagctggaactacaagtgtgtggcactatgctgggctaatattttaatttttattttgtagagatgggggtcttaatattttgcccatgctggtctcaaagtcatgggctccagggatccatccaccttggtgttccaaagtgctgagattataggtgtgagccaccacacctggcctataatcttatttagtatgtcttgagacatctgaaaattttctaaaattaaactatacaagacacattaaaaaacatacccgaatctccaaataaatttatatagcttatttatcagttatgaaaatatttccttctcagttttcttggtgataatcctacaatatagacaagatttagcaccagctcactttttagatatatataatttcttttgctagaaattaggaaatcattttcttttatttacctcctgttttattcttttactgaaatctttgtccttcctttattctaaaactattggttattttaatgcgtatgctgagaggagagattgattgttttcccatattttcacaaatgggaatatcaagaatagcctgaaaaattccacatttgagaaatgtttctatggccaatatgaaaattctctaaaacttaggaaaactcatatctttacccatttaacattttaaagagataaagcaaaacagtagaaagtcatgacaggcaatctgatcaaaattcgaaaatttttacttttatctttttttgtttgggtagatgactatgctatgcagaattttcctctatttttaagttatcaaaattaatttaataatatattttactctcttcttgttgttttttctagccatttttttttgttcaaaaatatgtttccattaagaattgctattgaaattttaaacttttatttactactacttgaaatggcgtctggatccaatagatatttgggaaaaaatgctattttttccaacattttcataaagtgttactccatttcatgacatttgctttttatatatgtactaattctcactcttcttaaaagtaaaacatctatacttacctcctagctacatgtgaacattgatttagtgttttgtagataatatataaccagtggtagataaggttgtatgatgactaatgatatagctataacattatcttgttttcactgccaaaaaatttttacttcacacactcagggacagatatccaatgcttccttgttgtttcttatgtaatcttgagagttaaaaatattgatagttaaaaatattgacagcattgttgcatttagtcatcttcactgcttttcagaagtaagtttcatgtaaactgatcagtaggttgagaccctagtgatatgtttcaaagcagcatataaaacatgatgctacactgttattttttaaaataccttttccagagacttgtcatagttgcactgcttttttctaaagaggatgttacaatttcagtgtgcatgtctatgaaataaatgtttttaaatataaacattaagtattgtagttatgcagtatttctaaggcaattccaaaactaaaacatactgtcaatataacatttgtcaatcagcatttttacctttaggaagtaattcttttttagaacactgtaaatatatttggacttcagacattcataagaaaagaagaaagtgtttggtagatcataacatagtttgttttcttactgtaaagcctttttctgtttatggaggctcaaacagcagttgagaaaataactgactctgctgtctattagattaatttcaagtagtcaatatcgcttttcatttgtagtcttcatttttactccagtttaggttatgtggggtttagtttatttttgttttttattcttcctagctttattatggtataattgacaagtaaaaattatatctatttagtacgtaaaatgtgatgtttggatatgtgtacacattgtgaaataattaaatcaagataattaacatatacatcccctcacatctttacaaatttttggaggtgagaacattgaacatctactctgttaacaattttcatgtatacaatacattattagctattgtctttatgctgtacaatagatacccagagtttattcatcttgtctcgcttgtctcacttgttcgtctttgactaacatttcaccattttcccccatccagtcttagtatttagaattccacgggactgagatatttctgaactcagtttcccaagttgattttgtggcagaaacctggttagagaaaaaacatcaacactttgagagtcactaaagttgcataaaacataataagaaaaatattttgtatagtaatgctaaaacaaaacaaaacaaaagctaatttactaataacttttgcttatgtttttatttctcctaaaaaaatgctgactagagcagtcttgttcgctacaaatcttaattctaacttttaagaagcataattacacccacatacatacacacacagatacacccacacacacacacacacacataagcaaatttaaatatgaactttatttaaatatgaactttctaaacctcttttaccgcatctgtaaaggaattaatttctatctccctgtgtcccagagttgtttgagaatcagatgagataactaatacgcaaactataaatccaagtactaaattctgaccttttttctctcttgcccaaattcccatctaaggggcttggggagtcatgccctaaaaatcagaaaatctcatcagatggttctgtctaaccttatataaagtggcttactttccaggctgactctggcatcacatcacatgacagataaagaaggaaatcaaaatatttagccccaaaatatgtttctttgccatattttgaagtggccctgaaaagccatttttatttttattgggagaagatttgcatttgtaaagaatctcttaacataactaggtcttttctcttccagatcctcgcagtcctgaagagactgactgatagtctaacacctgaaaaagtgagaatagaaaacatttgccatctattatttctaagggtggccacctatgatatttcatctacataataagaactttgatcttcaagaccccttatcttaacccagaaattcctttctattgattgaagttttaaataataacttgttcaaccaattgccaataagaaaatctttgaatccactgatgatctctaagcctcctcaacccaccctgacttcgagttgtcccaccttcccagaccaaaccaatgtatacctcccatgtattgattgatgtcttaggtttccctaaaacatatacaaccaaactgccacccaaccaccttgcgcacatgttctcagagactctgcctcatgccatggtcacttatgtttggctcagaataaatctcttcaaatattttacagattttgctcttttcatcaacaaaacacaagtcaaatgcaaaatagactataatcatttagaaagaagtatagacattgtctctcaaatggtgggagggcttattattaattttcatatgttaaattgctttataattttgttgatagctatcttacagtcttccaaatagaagcacaaacttcggtactagtaagtgataagtacatttgatacattcaggtgtaattaaaagtcatcaagagtctattttggaccaataaatttgctgatttatattgggtaggcacccacaaatacagtacatgatgttttcagtaagaagaggctatagaatacaacacaaaatggtgccatttagaaatgcaccaatgaaatttgtgagatggtttgcactggaccattttataataaatcagtgattcatgaaatataaactcaataaagatagatgccaactttcataactatttaagaaacagcctaaagattacattaaaatgccttccaaaatcacactctacaactcagataaaatgtaaataagcagtttttgcagtattgagatgaaaaaacaaatccattccgtgaaatagttttttaaatacaagttactaaaaatggtagtgtaaccatgatttaaattataataatgtttaaaattatttccctttgaagattttaaagattatatctgaagcacatttcctctttctttcagtactactcttctataagtataaagagaaagctttagattgctacatttgtataatctatgtacctttaaaaaatcaaagttattatgaaaagatagtgtctaaacttaagcagcatctgtcaaatgggattttataaaggattgagaatttaagaaatacatatttctagactggtcatcagaaatgatttcatgcttctactgccacctttaatacataatcacaaaaatgtcagtgataaagtcataatccctgctcaataagtcaagccatggaacctcaggctaagtgaaatttaagtcctttaaaactttgattttaccacccttgctcataactgcttggagggtttctgctatttttcttattagtaaatatttttatctgtaagttattttctatgtgatgcatggcctattgcatactctctattcctaagtatatgatatgaatttcattattctttaattcttaagacggcattgaagattggggctgtaattaacatgcacacacacacacacacacaaaagaaatggaaggagacatataacaaaaatgtgtgagttattctgcttaagaatatcaacttctgctactacagcaatgtttcagaacttcatttaattaacagagaggtcaaaaggcatattgaaggcagactatttaaaaccagatagatctgtatttaaattctagctttgtaagtagctaaaaccaaaaagaaattcaggaaatttaattaatttatctcaacttcagatttctcatctgtagtatcaaaatatgtatattttcctacctgttatctatgattttggaatgtgacacatgacacaagctgataatattagtgacaatatgtctacttgttcttccatttcattagacatattagtaataaaacattggtgttagtgggaatgaaatcctcaaacatttatttttaaccgattttgtctgagtttcactgctttcatttcaacatgcaaccctgctaaggtgaaccacgacctccatgtcatttaatgcaatgggtcatcacgctgttggagctaccatagcatccaatattgtggcctctttcaaaatattttttttgtttttgagatggagttttgctcttgtcgcccaagctggaatgcagtggtatgatctcggctcactgcaaccctcctgggttcaaacgattctcgtgcctcagcctcccgagtagctaggactacaggcacactaaaccacacctggctaattttatattttttgtagacacagggtttcaccatgttggccaggctggtctcaaactcctgacctcaagtgatccacctgcctcagcctcccaaagtgcgggaattacaggcatgagccaccgcgcccagcctgcctctttcaaaatattatttctgtgtttctgtggttttcatggtacaatatctttactttctatgttgtttacaaattccttttatatcattttatacccactcttaaatatcccatagatgcctcagagtaaataaaaaatcaaactcattagctttttaatcaaatgtgattctcttgcagattactttttgtgaattcaccactgtccctaggcctcattcttaaatcctccattctcgtcactctatttttctactcaatcaccaattttgtctttcgtatctcctgaatatttattaaaatcttccacttcatttctatcactcccacttagtccaagtactttttttctgttgttaactggtgcagtaatactttagctgaattgcctccattctctctgattttcttccactcttcacaggcagccagaataatctattcgttaaaaatcataaagattcttcctgcctcttttgaaaaacatttaatagcttcctgtttttcttaacgtagtcataaaattttttatcaaggcctataaggcaatatgcactcttcactccactactacactagaacttttgggttttgttcttatatcacattatgctacctgcactttgtaagttcatttcacactcaccttctcacttctgtacaagacatgtttctaccatcatagagttctactacaggttaatcctttctccttctcatttcccttctccttcttccccttctatccttccctgaatctccatgatttggcgaaatttgctaattgcattatctgatagcaccatatacttatcttttgtggaatttattgcagttgaaatttctacttttatttgcttttatctagaatttatctaggatatttattattttataagtttcccaaaggctggtatatctgtcttcacttgtcagttttttaaaagtgcctaagaacatgcctgagacatttagatattcaattaatttgtaacaaataagtgaataaattaatcaatgaaatattatgacatgaaagaaggagcaaatcctggatgctatgatgggaaattcaatatagtataatggtgtataaccaacagtagaattctactttacaatttatttacatcagtccaggaaattctgcaaacccacccagcacaactacaaagagcatacgtgggcttgttacatatgtcatacatttgtagaccttaacagagtataggcaatttgtaaaaaatatgagcttcctgtgctggagcaaagatgacacagaactagcccaatgaaagaaggaaggcattgttcgtaaaacctatgagaagatcctgttaagttcctagagagaaacaattaccaaaaggcatttgtgagaaatgaagacagttattatttattttattttgtgaagagatgcttaatgaaactctggaaaagctataaatagattcaaagtgatgttacaaatgcgatatacatataccccatgtatgtgttacctttccaaaagcagccattatttcctatcaccatacaacacagaactgattgacagtgtggagcaaaccatatatatgtaatggttataactcatttgttagagatctacatgaccataaattccccatttttgttcatttttattatttatcatttatcaaattctattatatcccgttaatgtcatagaaactcatttacacaacaggattttgacgtagtcaacactagcatccaatacattaaccaatatttttaccataaaggaactgatatcaaaattaattcaatttattttttctttaaatttagctagtaataacttattcatattcataataacttcttcagagtttataaacctaaaatttctatccttaacatcttttcagagcagaaatcaagtagatattgaagaataaaatgcaattatatttgcagtttcttatgtaattcaggttaatattatcctaaattatacttttatgagacaagtaattgtaccttgaactataaaaatgaagaatatgtagtgataaaagtgataatccatgttgaatactttgtaatatccaagtcctgtttatctttcagctcacttgagcatattctagcatatttccattaaatgtccatacaaaattcttgttctacttttgtctctctttcagtcaacattttgtataactgactaatttctcccatatatgtaaagaggagattttatttacatatagttttggttaagtattcttttttatttatatatatatatttttttgagacagtcttgctctgttgcccaggctggagtgcaatggcatgatctcagctcactgcaacctctgcctcctgggttcaagtgattctcctgactcagcctcccgagtagttgagattacaggcatccgccaccacgcctggctaatttttgtatttttagtagagacaaggtttcaccatgttggtcaggctggtctcgaactcctgacctcatgatctgcccaccttggcctcccaaagtgctgggattacaggcgtcagccaccatgcccggcctggttaagcgtttttatgtaggtcatcctgttatcattgtcaccatcaataagaagaaaacaaaggtgttcaatctgtgattttatgaactattgctcctactacattttaaaaatgtcattgaattctcagtctcttaacctgtatatttcctcagaatttctcagtgttcttctggcttttctttccttccctactcaagcttcatccagctctatttttgtcagtaagtcaactactgtagctcattattggaccttctcatgtgttttgtcaaatctcatcctgagtcaatccaatcatttgattctatgcttgtataacaacattaaccaaagttatttaagatacaaaaaaaatcacagggccgaatgtggtggctcatgcctgtaatcctagcactttgggaggccaaggagggcagatcacctgaggtcgggagttcgagaccagcctgaccaatgtggagaaaccctgactctactaaaaatacaaattagctgggtgtggtggtggatgcctgtaatcccagctactcaggaggctgaggcaggagaatcgcttgcacccaggaggcggaggttgcggtaagccaagattgagccattgcactctagcctgggcaacaaagtgagactccatttaaaaaaaaaaaaaatcacagcagcagcacacgttttatgccatggcacacactgatcttcaaaatcaactgtactctaaaagcaaattgcaaaccaattctttgcatcacctcctttttccaagagtgactcatagggttccaagagtgactcattgtcactaccacactcctctcaaaagatactgatagtttcagcttctctgagctattcacagccagtccctacacatctaatctcatccattcttacaattaaaaatagatttagaaattcattaattctatccactattttttactatttttgaaaaatatgtatttatcctattttatattaacaattcattaaagaagtgtctatatttgatctagccactctgcagtttttgttttctcattttgaaatggacctgccccgtagataacccatccaatctgcagtgggtgctgtagtgcgctgcccccatttcccttctgaaaccaaagagcccattattcctgcttccaggattattgcctgctgcctcctcgcagctaaccacctttttgggaaatagctttctgactattcaaaggaactgcctctcccaatattaagcccctttgctggaagcagcctatgtctacttgaatagttgatgcatctatttgtccttctgacctccttgcctcattttgagacaagagtgaagatccatgccagctctagcactccttgtggttttaactgagacctttgttgttatgttaagtgactctgaccatgtactgggagtgaatatgaggttgttgtgtaaactgtttcacaaattgccacccagatctcctctttccacactccactgacaatgaaagaggtgatcatttcccagcttctagaagtgttgcttgctcatagcaggaaaccgagtccctctccaggatggcctccagctgaacattatgccttctctctggcatcatcagtccacctccaactggataggtacaaaggccaaatcctcccattcagaaaatgctgaagggtcatcttatctctaaagctttaataggctctgaaattttattctccttgatttgctttcttcacgacttcacataatccacaactttctaagacatctctccatctcagagcctattttttggaaaaaccagctaataaaaacccatattcagtcagccgctactcacctactaaagtctttcttgttcagtggctctgcattgatactgtagttgacaatcacactctttaacacggcttacaaggctgtaaactatatgaactccaagtaaatctccacagtgcccatagtgcactccattctctggccatactaaaatgcctacatttctttgagcataacactaaaagacctgatctgctgggggtggtggctcttgcctataatcccagcactttggaaggccgagttgagggggtcatgaggccaagagatcaagaccatcctggtgatcaaggtgatcctgtaatcccagcactttggaaggccgagttgaggggatcatgaggccaagagatcaagaccatcctggtgatcaaggatgatcaaggatgttcaccaggatcaagaccaccaagatcaagaccaacatggagaaacctcatctctactaaaatacaaaaattagctgggcatggtggcgcatgcctgtagtcccagctactcgggaggctaaggcaggaaaatctcttgaacctggaaggaggtggttgcagtgagctgagatcgcaccactgcactccaacctggtgacagagcgggactctgtctcaaagaaacccaaaaaagacctgattagttactcttctgatattctcccttagcactctctgcagttcaaatcatagacctcctcacactctattcaagttatgaatttttgtttaatctctctcactgggtgcatggtgtacatcaaatgtcattcactgttgtcaatactacgttattaacacactgctttaaatatcaaagaagatcaacaaatattaattgaatgaattttatagggatgaataattaaggtatgcatatgtatatttataactggtggattttcttccatgttaatttatgtcagaagcacatacaaagcaggtatcatgtcttgtcattgtgctaagacttgggattacaaagataaataaattttttttatgcctcaagtaggttttaatttaaggtgtaacagtgtattaatgctttggattctgttcaatgcattaagtaatataaagatgcaggcatgcacatggtaaatagtagtaattgagagacaagtggcatgaaaattatttagaagagtaattctatgtcagcatggacgttatggtactaggaaggaaaaaagcctagtttaaaggctcattgctgtaatccagaccagaaaagacaatagttgcaataaagcaataattatggagatgaagagaattgggtggataagacagaaaaaaaaatatccacatagatcagagaggtaatacttggaaagtgaatgggcacatgttgtaaagaaagatggggagcaaagttgagttacagtcctcagctttagaaaagtaactgtaatttgtgctattacttcccacaaggaagattttttagaagaaataggtctttgagtgaagtatgaattctgttttaagttaattttgaggtgcctacatgttattcaattgatgataaattatagctagatttcatattgccctccattcatgaagcacttattgatctgttgtatggtagtcactattctagaaaatgggaaaaagcgataaatctgcacacttcctgctttcaaaatatattcagtggagacagaaacataaaaacactaacattacacattgggttaaatgaactgttagagatatattttacaataaaagatctctgtgccaagtcggcctgcacatggggaagaaggaagtaaaagtccaggaagatggtaaagaagaattagcatccaaacagaaacctgagggatgaatgataggcaaaataataatgtctaaagcaacttgaatcgatgttaaagaaactatttctcaataaatattatttgatcatttctaagattaggcatttccaagatagagaaaaatatatatatatttattatttgaaaatataacttttggggtaaaaataatatttttaatacagagtttacataaaatactttttgaattcactgaattattacatctaagaagagtaaactataaataattcaagaaataatatggagtattcatattgtatctagataagaatagattttttcattatataactaattcaccaaaccacagaaaaaggacaatgaacatatttgactatttaaaaaataaaaataaacttctgcacataaaataataagtaaataaaggtaataatattatagtctatattttaagcttcataatgtgaaaatattcatgacaaaatatcaagtgtcctatcatattttacatgtgtgctccaagaaaagacaatctaaaaattaataaataaaagatgaatcataggcatacaaaatattcagcctcactaacatttattagaataaaaatacatttatggagaaacttataaagagtctgctacattttagttatttgggtaaatattcaaatgtcaatagcaaacaagatcaacattctctgtttagatattattccaatctattgggaaaccaacaaaaaagtaaatagacgtaaagaacctgtatagcacagatccatatattgatacaattatacttagccccactgtgatatcattatacttagactcactgtttgttcatgctagaagatattttctaccaacactgtgatatttctctaaagatattatggggaataactaaaggatcatagaaatggcaaatcttgaaatttacattgtataagaaagtgaaccagaaggagaagagaaaggaaattgaaccatcaggaatgggtttactatactggtttggatgttttggtgactagtgcttaggttgaaattaagaaatagaattggaggtgtgaaaacagaaggttttattcagagtgtaaaaatattagaattgaaaatatttcttatgtagtagttctctgcaatgtgatagtaccttgtttggccacaggtctgaaagaaacacaaagtcagatggaaatgaaggtggtgaaaaataatttattttattttaattaaatgtgaacaaaaacaacaaatattccttgttaaatatatcttatcttagcttagctgatttaaaatctttcttctcaagctgtttctaaatttaactttatccagagttaaatcggaagatccgattcttgtttttttctcttcttttagtaagtttaatagatacgttactttgaaaaataagttgtaaaacaaattacaaactgtagattagaaaactaaaaaaaatttaagtgaaaatagaatccattcgctagttgagcagtcatgcctcattaactaaatctaaattgtattcttgcatttatcgactatgaagtgatcttatctctacaaaagataatacttctatttaattgattgtaggaaaagaaggaaaagtgatagcattttaaaaaagacattaccttgtctaaaactattgctttgctactttaattataattaaagaatgacttatttaagggtcttaaagtcttttttaaagtaggaaatatataattttttaaaatgaaaattcttcctttacagtggtttaaaagttgtcctcacaaaataacttcattaagtattttaaaatttgaattgcaccagaaattatttttacgaaaatgtttgaataaataaacacattttttttcaagggcatggttatcagatgaaggaaactgtaagcaggggtacacaaccccctggccacggactggtaccggttggtggcctgtgaggaacctggccacacagcaggaggtgagcttcaggcaagctagcattacggcctgggctctgtctcctgtcagatcagctggggcattagattttcctagaagcgcaaaccctactgtgaactgcacgtgccagggtcctaggttgcacattccttataagaatcgaatgtctgataatctgaggtgaaacagtttcatcccaaaatgatcaccccttcctccatccatagaaaaattatcttccacaaaaccggtccctggtgccaaaaaggttgcggactgctgctgtgaaggacctctagttgttttcatataattgaaagtaatataattaaaatgctattaatttttttaaaataaatgttcttattgtttataacaaaaatatccttgaatggcagtacttctaaattcagcaagcatcatattcaatttgaaatttcattgtgtaatattttaaaaatagaaacatatatgtgagaaaggatggataggaaagcaatataatgcaagaagtacccctaatccaactgtccaacttagaattgtgcaaaaaccatttattttcaaaaaatgagtttaaaaaatatacaagacatatttttgtgttattccccaatttttatcctcttgttttccttcacctaatgtacacacactgttggatttgttgacacatatttgttttattttacattattaacaaagttcttacccgtatatgtattacttgatttatttgtttgggagaattacaaatgtggttgcatgttccacgcatttttctttgactttcttttgttaaaattgacattactttttgttgtcttattttattttattgagactacgagttttgaaatctattctggtcatttaagttgtttcagaaagatattttaaagaacaatactgcaaaaaaaacctttttttttgataaatgttccctggagataatatgacagaatttcaccaggatatttacagtaattattgtatatttcatgtagtattttacaaatataggacctttatgaaataatgcaaattgctttccaaagtggttataccaaatccccatttctttcagcattaactaagagttataatggcttctcatcatcaatagaacttgttttttccagattactaatttttgctagtctggtgtacagtaaaaggagtaattcagtgttagttttatatttgcctaattattaactatattgagcacctgttatatgtttcttgccatttgcatttctcatcaattttgtatttatatattatatacaatgagatatattacccattgtagttattttatattacatattatatattacatcaattgtgtgtataaatatatacacattataatatactatgttaaccttgataatcttgctgaggcagtacttataaagtttctccaccataaagttaatcttttccctccttcccatactggactctttggaaagagaacactgtatgcagcccatgcctaagaaaggggaagttattttctatctccttgaggatgaaggatatatatatatatggatatatatatatatatatatggatatatatatatatggatatatatatatatggatatatatggatatatatatatatggatatatatatatacactcacacaataatggatgtacttacatccattatttgaagtttttctgcatgggacattagttacccatccatacttaattatttttcctccttttatatcagtatagactcatatatatttctttattattagaatattatccactactatttcatttctttgcttgcttaatctgttccagctcaggtcattggggggcctttgattgattcctgtgttcttttgacatacctctttattgtacatggtgtgtgtctcttaatgtgttacttatcatataaaatatcttattcaaaacaccttcttcagcttttccacttaaactttttaaaaaaaaatgtaaaattacattgtaatttcaaagattatcttttcgagtgctacaaatattgagattggaattgcattgaaatctgaagatcaatttggggagatttgacatgtatattataatgtaccaattatctataaatacatgtgtttatttaggactttgtgttgtcttacaataaaattttatatcttcacaaatggcacattcatttttttgctagttgcattcctaggtggctaatatttttatagaaattacaagcactttatattttaaatcttattttatgtctgttgctgatgtatgtcaaggaacactggtaaaggagattaactgcaggcacaatggtgttaggagctctgttgactgctccgtagtgaaactggcaaaaattataaataaataaatataaacagctatttaaagtctctagaaatcatgctaagagaaaacagcgaatgaagaaacatatataagacaaagaaaatgactgaggcaagtctcaatcaatttagaggtttattctgccaaagttgaggacacgtccaggaaaaaggaacaacaaatcacaggaacatttgtgattcatcctttctccaaagaggattttaggacttcaacactgaaagggaaaagagtgggaaatagggaaagaggaaagtaaagaaagaaggacaaaaaaggcaaagagttccattcttttgggactttgatgagtgcttagtgaattcacagcttccatgtgaaaggagggcagtacaacagtcaattatgcatttgtctcacactcagtgaatctaaatttttatataagatgaagtatacacagagtagaggaagcagtcaaataggcatctgtcttaggtgagtggaggattgacatctagtcccatctttgtcctgtacctggaaaaataagctgttaatttacagtcagggtgaaagtcaacagaactctgttttgtggtaaaaatcttagggcccacaaggaatttcctttttagcaggttgtgagggaggctatctggggagatacgtggcctttttatttttgtatctatctatttaggaacaaaatagaaggcagtttttttatatttctgttcccaagcttaacttttcccattggcctagtgagtttggggtcctgagattttttatattccttttacacatctaatcaaggaaatctataaagattcagtaaaaagtagagtctgtggtatttgacccgagtcttctccctgtctcctgtctcctagctcattgatttgcatactctacttaacagagctgcagtcaggaatacagggcttcctttcccaccagaaatcagttagagggatttcttctccgaggaccaaaacatcagaatttctcatcctgccacacctactttttgctggggctaagttctgggcaagcatagttgacaggtaggggaggtctcttacgccacctcgttctactagtggatcagaggtttcaccttgagtacagtcagctaagaaaactgggccctcatcaccctttccctggctcaaaggcagtgattccacatcaagagaggcaaactgagaggtcctcaggatgttgccccactctccacccagtgcttagcttctagagcaggagtttctctctgtcctcaaagaaaaccttgatattgtgcacagccacacgtccagagtgcttgttcagagatttttgtctggggagagaagcagatcataaagcacatacctcctaatctctttccaaaagtctgaattcatttgaagcagagggtagagaaactcaagcctaagggttgtctgaagaacagtggaagttgtagtgagggagagttgagagcaggttcaagatacaagctaatctgtaagtaatatactctgcaggacagaactggggaacaaggctgctccgataacccctactggggtcaaaacaagtatctaacactgaccttggaaaccattttcaaaagaattctaatttgactggattggttgtagaagaatgtatgctctaaggcattgttgaaaacacttgttgaattaatgggcaattagtagagtgtgacagctttgtatagtcaaggaaagagaggaagagaattaacccaaacaattgccatcccaggatgactgtaggcagatgcaaagctgcacctcccttagatttaatatcacgagttttaacctgtggaagaaaaggtcaagtttatgcaaataatctagcccatcacagaacaaataaaaaagtgaaaacattcaaagatcctgggggggtgggggcaaaataaataatacccagacattctacaatatactgtttaaaatgtccagttttcaacaaaaaattctgataaaaaacaagaaaatataaccccaaaactaagaaaaaaggcaacagaaattgtctttgaggttgaccacgtatcagatatatcagaaaaattattcaagagaatcattataaacatgttcacagaaccaaaggaaaccattattaaggaagtaaggcaaggtataatgacactcttgtatcaaatacagattgttaataagtagacaaattataaaagaagaacctgatgaaaatcctggatttaaaaaatatagtagaccaggtgctcaggcctataatcccagcactttgagaggctgagacaggtgtattgcttgagcccaggagttcaagaccagcctcagcaacacagcgagatcctatttctacaaaaactgacaaaattaccaggtgaggaggtacatgcctgtagtcccagatactttggaggctgaggtggaaagatctcttgagcccaagaggtcaaggctgcagtgagctgtgattgtattactgcactctagcctgtgtgacagagcaagactctgactcaaaaaaaaaaaaaaaaaattcgataactaaaaagtttaaacttcattagatggcctcaagaatatatttacactggcaggagaaagtctatgcagacttgaagactgaccaacagagatttgtaagccaaaaagcagaaagaaaaaggaataaagaaaaataatgtgagccttggagaaatgagggtcactattaagcacactaatgcatacatgcataacgaaaacaacaaaatgagagaagaaagtcaaaggagtggaaaagatattcaaataaataatgtgtgaaaacttccctcatttatcgacaaacaaattgcacatccagtgtgggcaccaaggcctttgtccctgtaaagcttcgctgagaaatcactgacatgaggcagagaaactagcaggagaaaaagcacatcgatttgtttaacgtgtttacacaggagccttacgaatgaagaagcaacttctcgatgagttatataaacttacatacaatcttgaggttatagaaagattgaagccttggatcctggtaagacaagtcatggaagctggagaaaaggaattctactgtggaacaataaatgatcactaggaacaattattagactgggaaacagaagttaattgtaaattgctctctggaatttaaacgaagcttggaaacaatcaatctcttgaagaaagacttgaacagttgtggttacattcttggtcttctttcctataacagataataagattacagggaatggaaggaaaattgttctctttggtgggttagtactatttttatgtacacaaaggaaaaatttcttctggtgcttgttgttgtccaaggatttttaattcaaaatatttactatataaatgagccatattttggggtgtaatattttgatttccttcactaggaagccgaacaaaccccaggcaggagaaacacaaagagatttacaaataaacacatcatagtaatagtgctgaatatcaaagacatggacaattatgaaaggagcaagacaaaaatgatgcattgcttagagaagaagctcactaagattaactgttgtgtcctgagtgtaaacattaaaggacagaaggcagtggggtaatatattctaagtgctctaaggaaaaaacagccaacaattctaagtccagcgaatctttaaaaaatggaggtaaaaaagactttcctacataaacgtaaaaggaaataattttctgttagtatatttgccaaagaatactaaaagtttttctggctgaaagcaagtgattccactggtaataaaaattcacaggaaaaaacaaagtgcaacaattcatctagctgtaatcccagcactttgggaggccgaggcgggtggatcatgaggtcaggagatcgagaccatcctggctaacaaggtgaaaccccgtctctactaaaaatacaaaaaattagccgggggcggtggcgggcgcctgtagtcccagctactcgggaggctgaggcaggagaatggcgtgaacccgggaagcggagcttgcagtgagccgagattgcgccactgcagtacgcagtccggcctgggcgacagagcgagactccgtctcaaaaaacaaaaacaaaacaaaaaaaaaacaattcatctagctatgttattatacaagagagtttacaggcatgctttttcctcttttcgtccctttacagatttataaaaagcaaatatattatatatatatttatttatataatatatataaaaagcaaatatataataaaatatatgtattaaataatatgtatataatgtattgttgatactataacatatagaaaagttacatgtgtaatatatttagcaataataacacagagaagatagatgaggaaatgctatattaggcaaaggaaatggctgcatgtggtaaaataatataacaacctattactggaattgtaacattaatagatgtaatatgtataaaatgatgcaacacaataggggaaaatgaataaagctctataggagtaacatctctatatatcactggatctaggttagtatacatccaaagttgattctgatcagttacaatatatgttgtaaattctagaggaatgaccaaaacaaaacaaaaaaattaacacaaaaatgtttaatgacaaaatcactgaagaaattaaaatgctatatcaaaaactattcactgcgaaaaaagcagaagaggaatatagaaacaaaaaatacgtgagacatatagaaacagaattaaaattttttagttaatatagttgaagatgttgtcaactatgtcaatagtaacataaaatgtgaatgggttaagcaatcttatcatgaggcagagattgtcagcctagatttaaaaatatgatataattatatattctttacatggaatacaatttggattcaaaaatacaaatagattgaaaatcaagggacggaaacgtatatatcatgcaaatagtaaacacaagaaagctagagtgactatagtaatattagacaaaatagaccttaaaaaacgttaccagagacaatgagagaagatagatattttataataataaaaaggtcaattcatcaagaatgtatacttatagtcacctgtacatctaataacctagcactaaaatacattacacaaaacttacagaaaataaaggagaaatagaaaattcaatagtaatactagaaacctgcaatactaaacatttaataatggatacaaccactagacaggagattaaaaaatagaagacttcaaaaattacatagaactaacaaatatctaaagtactctcaatccaacaacaacagaatatacattcatttcaggtgctcatggaactttctctaggatatcttctaggctgtaagacaaacttcaacacatttaaaaggatagagataaatgtatactttctgaccatatggaatgacattagaatcagtagcaggaaaaatttagggaactcacaactatttaaaattaaataacatactacttaataaccaattggtcaaataaaaaaatcaaagggaaattagaaaatactttgaaattaatgaaaatgtagacataacattttaaaacttttgaatgaagctacaacagtagttagagaaaaaaattatagctccaaaatatctatattaagaaaaagaaatacctcaaatgaataacttaaacttctaccttacaattctggaaaaagaagagcaaacttaacttacagtgagctgaaaaaataataaagattagaacagaaactaatgaagaaaatagaaaaacaatagggaaaattaataaaactgaaagctgattcattggagaagctaacaaaattgaaaaacctttagatagtcggatcaaaggagaaaaataaatgaagattcaatttttggaatcttaaaggaaagagaggacatttactactgatcttattgaataaaaaagataaaggaatattataaacaactatacacagacaaattagataacttagatgaaattggcaaactcttagaaagatacaaactagtaaaaccaactaagaagagctacagaatctgagtaaatctgtaagtgaaaagattaacaaggtaacaaaaaacctacccataaaataagcccaggtacaaatggctttactgtttaattctatcaaatatttaaagaattaatgccaattattcacaaactattccaaaaactgaaaaaggaagagacactttccaacttaagaagccagtattactctgatattcaaacttatgaggccagtattactgtgatacccaaacttaggaggccagtattactgtgatacccaaacttatgaagccagtattaccctgctatgaaaactagacaaagacatcataaagaagtaaaacctcgaaacagtatctgttatgagtgtggacgcaaaaatcttcaacaaaatactagcaaatcaaactcagcaacatatagagagattcatatgccatggtcaatgagatatgaaaagaattctaggctggcttattcaaacatcaatcaatgtagtacactatatcaacagaataaaaaacaaaaatttcataataatctcaacagtttcagaaaaagcatttgacaaaactcaatgcatttttattataaaaagcacacagcaacctatgaatagaggagaacattttcaacctaacaaagatcacttatgaaaaacctatggctaacattatacttagtgatgaacacctggatgcctactcactaagactgggaacacaaaaaggatgtcactaacaccgatcccatttaacattatgctagagggtctatccagaggaattagacaagagaaagaataataaaagtcacctataatagagaggaaggagtaattctatctctattcacagtttatacaatcttgttgatcctaaggattccactaaaaaactattggaacaaataagtgagttcagcaaagttgtagaataaaaaattaatataaaacatcaattgtatttctatatactttcaactcaactgaaaaaagtcttaaagaaaacaaaattgttaggaataaatttaattaaaaatgcaaaatttattctctgaaaactataaaacattgctgaaaaaacctaagtatttaggaaaaatttccatgttaatgtatcagatacttaatgctgttaacaaggcaatattcctcaaactgatctatagattcaacaaaatccccctcaaatcccagatgacttttgtacagaaaactacaagctgattttaaaatttatatacaactgcaagggaactaacataaccaaaattatcttaaaaagaagagcaaaatagaagactcactcttcctgatttcaaaacttactacagtgctgtggtgctcacgacattttggtaccggcacaaagatagacatataaatcaataaaatagagttgacggtgcagaaataaacccacacatttatcatcaacatacttagtaagagcggcaagaccattcaacaggggaataaaaaagaatagtcttcttcaacaaatggtgctgggaccattagaaatccacaggcgaaagaatgcgtttagatccttactttgaactctatcacactgcattctgcctgttacttaaggttttcatttttttattctttttttaaaatgttatgactgcttttattattgactttttttaaaaaaaagtatgatatgtatgtaaaaaatgtgtttcctgtaattgctgaatgtaggaatccttatattaatatttccatcaaacacatcttgtcaattacgctctttgaatctatgtggtatttgtcactgttttcgtgtatgtgctcacgtgtatgaccaatggattaattatgtgtgaaagtcattttcaaatatctcactatattgatgtatttcttaatgtctccatgtatttctgtcaatttatatatgctgaacatatattgttaagtgcataaaagaacggctacccaaactttcatttgattggcatttgcttgatatattttgtttatactttaacccatttatgcccgaggttgcaattttttgaatttttgccatcagaccttggcgatgactttaagcagtaggatataaataactcctacatacttagcgttccattaatggaacactagcctcacccctttttatctattttgagttatttttctgtgaagagcatatagctgattgtctttgaactgtcagtgttaacctagtaaatttagaagtctgtctatattcctttattttattagtattatatttaaacttttttgcatactctaattgtttacttttcttttgtcatgtatttctcatagttcttttctctttgcacactttcttttaaattgagtcggttttctctttttattcttttatattcactgccttaaaactatgtattctgttttcattctatagttcttacattttttatatcactgtgcctccttccagtcagggattcagggcctgaaacagaaaccattcaaagtatattaaggagagaagatatttagtagaagaacttggtgcttataaaattattggaagaatattctttagagtctgccactcgaactattgttaaaatcattcatgccatagtgtggtttctctccaagtatcaggaaggcattgcagaacactgtcaccaccagagccaccaccaccatcactgcaacaaccaccaccacgccaccacccccatcaccaccaccaccattaccatgaccaccattaccaccaccaccaacagcaccactgccaccaccactgccaccaccaccacccccatcaccaccaacaccaccaccgtcaccaccactgccaccaccaccaccaccatcaccaccaccgccatcaccaccatcactaccactaccaccaccatcaccatcaccaccatcaccaccaccaccactaccaccaccaccatcaccatcaccaccatcaccactaccaccaccaccatcaccaccatcactaccaccaccaccatcaccgtcaccaccgccaccaccaccccatcaccgccaccgccaccaccactgccaccaccaccatcaccatcaccaccatcaccaccaccaccatcactgccaccgccaccaccgccaacaccatcaccatcaccaccaccaccgccaccatcaccactgccacaaccatcaccaccaccaccgtgccgccaccacaccaccaccatcaccaccaccacaaccaccattgccactatcaccgccactgccaccaccactaccgctgccaccaccttcaccgtgccgccaccgccaccaccaccatcgccaccatcaccaccaccactacaaccatcaccaccaccaccatcaccgccgctgccaccgccaccaccaccaccaccatcgccaccatcctcaccaccgctaccaccactgccattgccaccaacacaatcactgccaccaccaccaccattgccaccatcgccaccatcaccaccactgctgccaccattgctaccaccaccaccattgccaccatcaccaccatcacccacaccaccatcaccaccaccaccgtcaccaccaccaccgccgtcgccaccaccaccaccacaagcaccactacaattgtctccacgcataaatatatgtatgtatatggaatagtaaatctaaccacttgccagcaaatatagaaaaaaaagcagcaggaatttggcatttctgtcatcccatgctctagtttgggcatgttagtgataaaacccaatttgtatcaatatctctatttgcaaagaatacatccatttttagatttttagcctttatccaatgggctattcactagaaacaaattggaaaggaggtagagtgcaaaataatcatgtccattgtagccctcagtatccacatcatcctgtaactcaatctaaaaacaagtacagcaacatcatccttaacaggttgtaaatcttgctcacacaaaagaaaacatgctcactctttttccaaaaagcgaggctaaagcctcatcagttgctctgcttgtcctattctacctctgtcacattacattctaaacttcaaatactgatgggctgtctgtctcatggggactcggtattccatgatcaggggttaactttctgcccgtaaccaataacatgccaaaagtagattctcaattttctgcctttgccaaagagatcagagttttatttgcacattgcttgtttcattaagattctcctgaagaagaaactgccatttttccatcagtgtgataattgcttttggtttactaattctaggggattggctgttctcgggatttaacttagctctttctacagcattatctctcactccataggtcacataactaaaagaagaatgtttcctgtgtctgtatgtgttgatgccaacagttaattcaaaatggaaaaataatcacagtatgcatttagggacactctgagctcatgagaatggattcaagtcaaaattcctgtttatcatctgagtcccccattatgatagtaaaccagaaagtcattttaattctgtagtaattattactatttcagagccagtattcagtaatcccccaaagtctcggtatttctctttcctcactgcatgggtacatggttaaattgttttcagtccctttgggaaagactagcagctgtatataaagcccataaatgtggccgttcacagattcacagcttccccctcattgaggaaggagtgggggtgtgaactagttccactaagggaatggggtataggctaaaactctccagtctaaaattttaaatattatgtttaaaaattaaatttaaatcttaaatttccttaagtcaaatatccttttatgtcagacaatttaaaatttgtggtttaatagcaaggataaatttatgttggcttctacagattcaaactttgaaactctacattaaaattaacaccaccatataattttggccttcctgcctattactattaaacaagtctgttcaattatctatcatttaattactgccacttgtgactccaatatccagtcatccttgttaatattaggaaacccatttatatagctgtttcttcacttttattcttggcttcagagaaaagccactaattacttcacctttcaagaatgtggatattaccttaaccaatcagtccccaatggcttgttgaatgttgtgtactctgaaccatgactaacaatacaaatacaaatataggtcatgtgtgttaaatatattttaattttttatatgtctaagccctgcatttttttctctgcattctatataggtagcctagtatctcaagttcatttagagataaccaccattatatccacattttattcaaccagtttcttaaacagataaaatacttctttccttttggatgagaattcagaatttctggtaattgatattgattatttgatcctgatataaaagtattgcctcttctttataccagcacacttacaatttattttcacatatatttccaatagtttgctctataaatgaaaaaacttttgcctcttttgttttgtaaccttcccctttccaattcaaaaattgtaattgcctccgtggatcatgctgtggtctgattatgaatatagaaggtataaagggtgatatggtttggctgtgcccccacccgaatctcatcttgaattgtagttcccataacccccacatgtcatggaagggatcttctggaaggtaattagattatgggggcatttctcccaggctgttcttgtgaaaatgaattctcatgagatctgatggcttcataaggggcctttcctgactttgctctgcacttcttcatcctgccgccatttgaagaagtatgtgtttgcttccccttctgccatgactgtaagtttcctgaggtctccctagtcctgtgcaaatgtaagttaattaaacctctttcttttataaattacccagtctcgggtacgtactaagagcagtgcaagaacagactaatgcaaagggcaatgcgaattattgtgtgtatggaggcaaaaagcaaaattaatggggaggaaggacaataattgtttttttagtactacaataccaaagattggggaagaagtcaaagaaattatatcttttttatttttgaatattaagataaaaatcatacagccgaattcactctttgttttttgtttgtttgtttgttttagacgaagtttcactcttcttgcccaggatggagtgcagtggcaggatctcggctcaatgtgacctctgcctcctagattcaagcaattccctgactcagcctcccaagtagctgggattacaggcatccgccatcatgcccagctaatttttcatatttttagtagataggatttcatcatgttggccaggctggtctcgaactcctgacctcaggtgatccaccgacctcggcctcccaaagtgttggaattacaggtgtgagccaccgcacccagccagaattcactttttttgacatagaattctgtgactcttgacaaacatatacattatgtaaacaccaccaaaataaagatatttaggctgggtgtggtggctcatgcctgtaatcccagcactttgggatgccgaggtgggtggatcacctgaggtcaggagttcgagactagcctggccaacatggtgaaaccttgtctctactgaaaatacaaaaattagacaggcgtgttggtgggcgcctgtaatcccagctacttgggaggttgaggcaggggaatcacttgaacccaggagaaggaggttgcagtgagctgagatggcgccattgcattccagcctgggtgacaacacaacaacaacaacaacaacaacaacaaaagatatttaatatttccattatataattccctcatgcctgtttagaatcttcttgttccctacaaccagcccctgataacaactgatataatttttgtttctattgtttttccttttccaaaatattatatgaatgaaattatatgatatgtagtctttgagtctggctttcatttagcatgatgcatttgtgatgcattgcaataattcatattattgtatgtgtctttagtttgttcttcattgccaaggacttgtccagtgcataattattccacagtttgtttatacagtccacagatgaatgaagggcattggaattgttttcagtttttttttttttttaattgagacttagtttcgctctgtcgctcaggctggagtgcagtggtgtaatctcggatcactgcaacctccacctcccaggtttaagtgattctcctgcctcagcctcctgagtagctgggattacaggcacccatcactgtgcttggctaatttttgtatttttagtagagacagggtttcaccatcttggccaggctggtctcaaactcctgacctcatgatccacctgcctcggcctcgcaaagtgctgggattacaggcgtgagccaccacaccaggcctgttttcagttttgggtaatcagaaataaagtctttgtaaacattcatgtacaaattttgtgtgaacccaggttttcatttttctcagatcaatacacaggagtgagatttttgtgtagtgtggtaactgtatatatgtcatattttatgagaatttgacaactgatcagtacaatagctacatcaatatagccaccacacccagctaattttttgtatttttagtagagatggggtttcaccatgttgcccaggctggtctcgaactcctggcctcaggtgatccaccctcctcggcctcccaaagtgctgggattacaggcatgagccaccacacccggccagaattcactctttttgatatgtgtatttctaacagaaatgtatgagagcaccagttgctctacatatttgccagcaattgatattaacattttctggccaattctaataagaatacaacagtatctcatgtggttttaatttggattttcttactgacttatgatgttcagcatcttccattcatttaaattatttaccatttgcaatcttctttgataaagtactcaaaatattttgcccatttttaattgatttgattttgtattgttgagcttttagtgtcctttatattttatgaatataagtcccttgttacacacatggtttgcaaatatttatctccgactgtgtgttgtctttctattctgaataatccagaaacccttaatctactgagtaccaactgtaagaatctataactaccctacgtacaaaaagctagaactaggcattggtatgaatagaagctgatgagagaattgaaaagcaaaagtgaaagagaattgaggtgggaagaataatatggaaagaaacaaaagaggcacttttttttttcacttaaatgaccatctgatatcaattctgtatgtatccaaagcaaataaatgagaaaaatggagacatttgaaccatcttctgcaatccatgtctgtttatgagtgacttaccataataattgtcattttgtcgacaaactgccactacatctcttttagatgctatgattaacattgaggcattataatttagacagctattctaatggttgtacagtgctgtggcattggctgactcaaagcaaacattagagagaaagtgatccaagacacataaaaatgtacagaataattaaaagtagcaagtataaactaacgaaaatataagaaataatctcaacaaaaacagagtcacatagagacaaatctggttgcaacatttgatatgcaggaaatatgtgtaaggcttgggaatatttcgaccagaaagctagcacaaagttctactctttaaaattaccagatttttttttttctttttgagacaaagtctcactgtgtcacccagactggagggcagtagtacgatcaagtgattctcctgcctcagcctcccgaatagctgggataacagttgcctgtcaccatgcccagctaatttttgtattttcagtaaagacagggtttcaccatgttggccaggctggtcttgaactcctgacctcaggtgatccacccacctcggcctctcaaattgcagagattacaggcgtgagccacagtgcccggcccagatctttctttctctttcttccttcctttctttctctttctttctttctttctttctttctttctttctttctttctttctttctttctttctttctttttctttctttccttccttccttccttccttctctctctctctctctctctctctctctctctctctttccttctttctttctttttgagtcagagtctcacactgttgcccaggctggagtgtaatggcttaatcttggctcactgcaacctctgcctcccgggctcaattgattctcctgcttcagccccctggctaatttttttagtttttagtagagacagggtttcactatattggccaggctggtctcaaagttctgacctcgtgacccacctgcctcagcttcccaaaacgctgggattacaggcatgagctactgcacccagcccagaatttcttatagaaattgtctatgcaagatattggttctagaaataatgatgacttctctctattattcaaacttaaccactagtgatatttgcatattagtcaaaaagttattttctttaattagagctccctttttgttgttttatgttcactgagttttgcacagaaataaatttgtcttcgatatttaaaaaaagaggtagtgaaatcaacttgcattaaatattgagctccactgtgatgattatggccacttgccacttcagaattcacaagtgcagtggctgtgtgactcaacgtctggccattgacacgtgcatagattttttttttagtgagagttttgttttgtagaaagtgttttcttttgttgttgttgttgtttttttataaatggggaaagagtagatagcattgcgcccttttctttgtcatcctgtctttcaaataaatgcatttttttagagcagaagcagttgtctgtgaacaaaaagtaacaagcatggggaataaagccattacactttgagagaatactgtgagagataaaggctggcatctttgatctgttgaattgatgcaggttacatttacttctagactttgtgttatgtgagaaaaataatacatgtgttttaagccactgcaagttggatttttttgttacttgaatgagaacacggttatagctgaaccgaagttggcttagtaggccggcatatgtaaatgtttacttatgtttaaatgtttaaaataaaagccaagtgtgaatttgcctgtttgaatcaatattcactttctctcaataagcaataaacatgtatatgtttggctgggcatggtggctcacgcctataatcccagtgctttgggaggccgaggtgggcagatcacaggtcaggagatggagaacatcctggccaagatgatgaaaacccacctctactaaaaatacaaaaaaaaaaaaaaaaaaaaaaattagctgggtgtggtggcacactcctgcagtcctagctactcaggaggctgaggcaggggaatctcttgaacctgggaggcggagattgcagtgagccgagatcacaccactgcactccagcctggctacagagcgagaccctgtctcaaaaaaaaaaaaaaaaaaaagtacatgttcagtattcctatcttttattatggatacccagatactaacacaggatgcatctatatgtaagtttcaagaactcttctgcaacatctttggtgttgtttggagttgcattactgctttgtatgtcagttatatatttgttacagagttatctattttcctgtttaatttagaaaaaaacatataatagaaagaggaaaattttaaaaaataataaaactatatttttcataagataaaaaactttatagatttttgatacatgaataaaagacacactgtggaaaaatgtttacatatgtcattgacagagcatcattttaatagaatgaggcatttggggattgatatgggttgaatgtgtcccctaaaaggatatgctgaggtcctaaaccccagaacccgtataatgtgaccttatttggaaaagggtgattgcagatataattagttaagatgaagtcacattggagtacggtgtaccctcaatccaatgtgactggtacccttataagaagaggagaggagatacagaggtgagaatgccatgtgaagacaaagagacacataaagggaagaaagccatgtgaatataggagcacagattaaagttaagctgttataagccaagaaatatctggggctatcggaagatgaacaaggcaaagaaggatttaactctagaagcactggaggaaacatggcactgccaacaccttaatttcagactcatagaccccagaagaactttctattgttttaaattatccctttgtactattttgttatagcagctctgggaaactaatcacagagaccttgggagggagggagaatattttgcctgtgaaagggatgctaatcactgggagtccagggagctgactttggtgagctgagactttgagatgacgcaattaccttcacctcctaatagtcacacctttgtatcgttctcaccacttgaatgggacctgaatatagtgacttgcctctaacaaataaaatactatgggaggtcacttctgaggttagattatagaagactccagcttccatcttgggtttttatctctcttattcttttgctctctcttggatttctcagcccaggagaaaccagctgacatactgagagacaaccctgtggaaagacatgacatgggactaaggctgccaatgatcatttacatgaatttggtatagaacctgcccctgactcaagccctcagatgagtccacagccctgagaaacacttgactgcaaacttttgaaaaaccttaacccagaggtgcacaggtaatccacatctaagttctggacccacattaatgcagagataacaaatggctgttgtcttatactactaaatttggggctaatttgttacctagcaatagataactaacacagtcaataactagaaactaagctaaaagatgatttctttaatataacaaaggtacagttggtgtatttggcttctcttcccccattggtgagagagggatacctgccctaagatcatggggatggctgaacctgtgctcctcaacacaggagaaatgtgatcagcagcagtttcttaggatatacacatacagccaaggagaggaagacattacatgccatgcagggtcacacagagattgttttggaaacagagtggacaagaagcggcaggagaaggcagattttgtaatgctaagaggatggggtgccccctggttcctgcaggaggatgtgcttggcttgtttgaataattccacagtctgaaagagaactacatcctgccactcagggataggaggagtgttacctggtcccccttgataaagagggttgtttggctagggagaccttatccacagggctagaacggtgaggagaacttgtcaagccattcatttgagtctacttggttttaccaaacgtcaaggcaacacaccattcagggcttacaccataaggttcagctacataattttcagagcctacagcaaaaggaaagtctggagttccttgtataaaaaaacaggaaaacaatgccattaaagcacagattatccttttctctgcagcctctttcttgatttattgtaagttttcttgtttgctatttaatgttgttttaagtaaagaaaaatttatactttaaattattagaacacattttgctgttcatctttatatcatacaatgacagttttaagtggaaatatgagagcatttaacttgtgtgcagagtaagcaatgttaagcaatttgtttcttggggcttatccaggaagatgcctctagcaggccagaaacagaaaaatcacagaccagactcaaaaagggttgaagaaggaagaaaggctccttccaggcaagaagctggctgaaagagcactccaggcatggaggtaatcttggagtgcggaccttcccaagtacatggggctaccaccctgtcgtgtggaatgttcattcctgccagccgccaaactcgcattccacactccagcctggaaggggtctggggaatttgagacagaaactttctcacaagctcactgccccaacccatggcagatagatgactctcaagatctttaaatctttgtgctgggtcatactagttatctgcatgggggtgggagagaggcttatgctcatagagatgccacctgtggatgaatgctcaccagacacccaatgatatttgggtgatgggccaccattccttgcactgagatgctatgagctgcaggtacccaaccccactggacagcaagcaagaaaaagggctagcaggaccgctgcaccaggcaacaagagatgggctgccgagatcccatgctacagtgacaacaggaaaagtgactttgggtaaataggggctgcacacacccagctcatccaccattatcctaccagaattcattgacaaaatacaaatttaaatgtcaagatgaccagggcagaacattaaaccctaagcagagggccctgtaaaactgccctggcagcttaccataaagttggccctgactaaatgtcaatgatgaagggtccaattaatagcattgcacagcacactggaaggcccgtgaaaaaaatctgttagccaattgagcaaggtgagagcttcaggaaaatcaaataagaaagaagaaggtacagttaggtaataggctaaatattagttctgtaatattttttgaccttggaaattctggactttacctattgaaccagcaagggtcaccaaaggccatttccactagtagggaaaatgctgtctacttaccatgaaaatctacattggttgtttggtatgagtcacaaccagctggctagagatcattgcaactgtatatgtgtcagaaggtctttttgactgatgggagagtaggattctgattgcataatactatctcatggtaaatttttataattttttaaaataattttctttcttttttatttttttcttttttatttgtttatttcatttatttatttttttgcatgattgcaactcactgcagcctcaacctctggggctcaagtgatcctcccacctcagcttcccaagtagcttggactatatagctgcacaccaacacacctagttcgtttttttattttttgtaaagacagggtctgactatgttgcttaggttggtcttgaactcccaggttcatgcaatcctcccacctgggcctcccagtgtgctgggattacagacatgagccaccatgtgcctgacttgcagtaaatttcagtaatttagcccttgttacaaatctaagtaacagtgtgagtgcaggcctccagaacacctcagtgtgtgtaagggtgcaaattatatggtgacatatggtagcaaaattctaattccaacggcaccagtttccagatcttagtttttatagcaccctctatctccaatatgacactaagacccacttttcccaaaacaccagcgaagccttgtcatgaaacgtgataggagcacaatctgtgctgttacacttacctcgattcagatgtccattcccagagatctcatgtttcggtaaccactttgtctcttgtgagctgaagcaaataactatgggcactacgtggttttatttttaatttatttatctgggacagggtcttgctctgttgcccagactagagcgcagtggcacaatcttgactcactgcagcctcaaactccttggctcaagtgatcttcccgagaagctgagtctgcaagtgctcaccaccatgcctggctaatttttgtatttttttagaggcagggatttggtatgttgcccaggctggtctcaaactcttggactcaagtgatccacctgccccagcccctcaaagtgctgggattacaggtgtgagccacggtgcccggcccactaaatggttttacattggtctgggtactttggttatcttagcattgttaattttcaggaaccaatttatttgatatagagtatagagagttgggattcatttaaccagtgacttgttgccatggactgaatattagcatccctccaacacttgcatgttgaagccctaatctccgttgtgttggtatgtggaggtggggcctttggaaagttattagcttatgaggatggaggcttcatgtagtgcccttataagaagagaaatgagagacacaatctctctttctgccctatgaggatacatcgagaaggcagccatctgcaaaccaggaaaagactttcctaaacaacagtattagctagcaattaatctttgatttcctagcctacagataatgagaaacaaatttctattgtttaagacaccaagtatttttgttatatcagtccaaactggctaaggcactagtacattccacaggtagttattgagtgtatgctatgcttaaggtactggtctaaggaaatgggggtacgacagtgaacaaaacgaagcccctgctagagtcagtaagattgttttctacaggtaaacagataacaaatttaaacagataaataaataaatgtcatgttagatgatggaagtattctgaaaagaaataaagcaaaattaatcaggactgggcttgtcagcaactgcttatccttacttttctaatggtgttcagggaatgcctcactaattgggtggttcttgagtgattatcaagaagtagcaagagagcagtttgcaggtggtggggaatgtgctctccaatagaaaacattcaaggggaaaagtcttgagagaggaacaggactgaatgtgtgaataatggcgaggaagccatataataggtgtaatgcaaggaagaaaggggagagagtggaaggagatgaaatcagagaggaacgaagggtcagatcatgaagggttttgttataaggactttgattaggagtaatatagcaagacattgtagagttgggagcaaaggagtgacaatatatgattcatactttttaaaggatgattcaggcttttctgtttagaatacactatagaatagtaaatgcaaaaataaataaataaataatacaagaaaaatgcacattcacctcttgcctgaatgaatgtcttagtctctgaactgaaagtctacactaggaggctagtagtggaggtgttgagaattgatcaaatgctggacatatattaaaaggagtataaacaatatttataaagaaatcaatgccaggtgtgagtaagaaggaggagaaaagggtgattacaaggtgtttgagttgaaatattagagaatggagttgtcatttaagaagagagaagaacaagtttgtggtgggcaaaattgaaagttcggctctggttatgaagtttgaaatacctctttgtcttgtaggatgagatccagaacccaactggacatgagtcagcttccttagagaggaagtatgggctggagatacacattttggaatcattgatctagaaataaaactagaagagattaactaaggacttgatgtgaatagaaaagagaagctgcctaaggattttgctccagaacgctgcaacatcctagggtcagggtgataaggggagatcatcagagaggtctgaacagaagcagccttagtagaagtatatgctagaaataaacaataaaaatgtttccagaaatgcagaatattcaactcgttcaactactgatcctataatgaagaatgagaactaagcactggtcttggcatcaacataggtaacaaaggctatttgcgtacaatattggacagaaaaacctgaataaagttgtttctacgggaaaagggaatttctttgggatttggagatctggagtctaacattttttgatatgttttactgcactggtgagaggagaaatgggtaagcacctaaaggcaaattttgaggtttagtagactgagagagcccctcaaagatgtacacataataatctgcagaatctagaattatgttacttcatgtggcaacaagactctgcagctatgatcaagctaaggtactcaagatgtgaagagaatccaagattatgtgggtggacccaatgtaatcacagggtccttgtaagaggaaagcaggagggtgagactcagagaggatgtgatgatgaaaacagagatgagacagaaaaagagaaaaagacggagggaaagagggaaagagagagataaacaaagacaaagagaggcagagacagacagatttgaagatgctatattgctggctttgaaggtagagaacagggtcataagatagtgactgcggggagctctgggagccagaaaaggtaagaaaatagactctgctagagactccagaagaaatgcaacactgccaatacttgaatttagtccagtgagattaactttaggcttctgatgttcaggaatgtagataatgtatagaaaatacatttgtattgttttaaatcaataaatttgtgacaatttgttactgcagcaatatgaaactaatgcagagttcaaagaaatttcaaagctttatatgaaatataaatctttcatatttttaaagaagttgcatatttagttacatatgtaccactgaatactgaatagtttaaaggaaatatttgtgtaacttcaaaccatatagaagactcccagtaatttaaagctcctcatatactccttaccaatcaaaatcccattaaactcttagaggtagctacaagtgaaatttacaatatggttgacctatgaacaatgttggggttaggggaaccactccccatacagccaaaaatcaaagtgtaactttttttttttttttttttttttttagagtcctgctctgtagcccaggctggagtgcaggggcacaatctcggctcactgcaacctccacctcccacgctcaagtgattctcctgtctcagcctcttgagtagcaggaattaaaggcacttgccaacatgcctggctaatttttatatgtttagtagaaatggagtttcaccatattggccagactggtctcaaactcctggcttcaagtgatccaccgcctcagcttcccaaaattctggggtaacaggtgtgagtcaccgcatctggcccccaagtgtaacttttgactcccccaaaaggtaactactaatagcctactgctgactagaagctttgcagataacataaacagtggattaacacatgctttgtatgttatatgtattacttactgtattcttataataaagtcagctagataaaataaaacattaccaaaaaatccaaaaaaaagatgatctatttgctattaatttagtggcagtggatcatcattaaggtcttcatcttcatcatcttcacatcgggtaggcctaggggaaggaggaaatgtcgttgttggtgttgctgtttcaggggtggcagaggtagaagaaaatctgtttttaagtggactcatgaagttcaaacccatgctccagtgtcaactgaaattgtttcaatgttttctactacagttttgccatctaaaaatgcatcctctaaaatatagttttgattggtttgtttgaatgttacataaatggagacatcaggatacatattttgtgtctggtttattgcactaacataaattgtaaaatctacttatgttcttgcatataaaaatcaaattttcattgatatatgaaactccattgtctaaatatgccagaattaaatgctgataaatgtttagttatttccttggttttgcagttatagacaatgttgttatacatctattagttaaataccaagaaacacaatctataagccataggctacacggaagtttaactttattagaaaataaaatacacaaatgccttcacaatacagtatcatcagcaggatattaaaacttcctttggtctacatttttgccatcacttggaattatcaaacacattgatttgtgtctatctggtaggtacatagtctttgttgctttttgaaactttattactaataaagtaagaaccaccaatgtttatattttttcttgaccatttcaaattttctattgatttgcctttttcttattgacataaaggagatctttaggttttctagttagaaacaaggtattttttttcctccttttcaatggcatttcttaaccactggagattttgaacttcaaagacataactagtgtaaaagaataaaactccagagttaatatactccaggtatattgggacattttgtgaggacatatggattctgttctgaaaaattaggtagtatctggtaacatgggcttgaaatttggagtgttttaggggaaagagagcaatgatccgtaagttaccatgaggagcaaagaatacaacctcatcttcctaccaactgatttgagagacttggagagaaattgccacaacctgtggtaccagcagttcagaagcaacatcttttgagaagagccaggttacagttagggcaaaaaaataaaaggaataataaaaaaagagatgagatatgtgttccagaaaggggagtggaaaggttttcatgtttggagagaggtggaagtttgtgcagtgttgtgtgaaaataggattccgttaaggtgtgagacattgcaatttgagagaaaacctggttacttaggacattttgtggtgattaacataaacatgcaaaaaaagcatggagagattaatcctggtctcctgaaattattcattgagactttgaatattccaggggcaaatgcctgctgtgacttccctcttttcctgctaagagcaggctgcaagccaggatggaatttgttatcaggagaacaagatctcaagccctccttcttcattccttttgggcttgaataagggggttacaaagctacattttaagaggaacacatttatgtaaaaattgttcatgggaaaaaatcctagttttatagagtagtattttctataagtggccaatctaaggtggaaaagaaattgaaagcactctgagacaaaattttgtttacaagatagagacagtcagggcaccagtccagagaaatactgcctcaggtttagatcattttggtggtgcaacagtcccagatatctttcagccaataaccccgtgtcattgtaaatcaagctagtctagatgattactcttctgttgatttttggcaagtgaaataatgaaccacgggcatgaatcaaggaatgctttcttttctcagtgttaataaaatgtgtagtagtgtgttttgctttatttcattgcatatttggggtctgatatagaaaaaatataagacaatgatatttatcatatttttaaataattttaaaaggctttcttgtgtataaatagaaatgctgatagaaatattttttaaaatagggtccagtggctcatgcctgtaatcccagcactttgggaggccaaggcgggcagatcacttgaaggcaggagtttgagaccagcctggccaacatggtgaaatcctgactccactaaaactacaaaaattagctgggtgtggtggggtacgcctgtaatctcagctactctagaggctgaggtgggagaattgcttgaaccctggaggtggaggtcgcagtgagctgagatcgcaccacagcactccagcctgggtgacagagtgagactccgtctcaaaaaaataaaataaaataaaatagaataaaaccactaagaacatgcatttagcaaatctcatggagacagtaccaccaaggttctctgactttcagcaaaggagaaaaattccaatattatattgatgctccatatcatttagggcaaaggcaaaggcagtataagtcaggtgactttctttaaccagttagaaaatgcaggctgcagaggaatggtccatggtcttggagaaccacatggagaaaaattatttccaacacagctgctgaagtgaaaagtgcaaaatctcaccttattctgacaactttctttctctttttctttttgtaagtatgttcatatgcttgtctttcttgattacacacacacacatgtactcaccaccatttctgtcatcatttggataacggatgctttatatgtttaggtactaagttatgtgaacatagagaggtatgaatgtctaaggacttttaatgaagtaaacctgtaaaattttaagcataagtattcttgtttttcaaaaaaattgctttcatttatcactatttttaaagtttgcataaagtttaagagttttcttgtaggttgcagtctgttagtgaatatgaattcttaataagaacctatggtatgcaaaatcaatggtgagttactgagacagctaatagagaaaaattggccacaagatctgaactcttagaatctactccaattcatgctttctcttaggaatcaaagagaatattggctataaaccttaattttatgaaaatagaaaataaaactgtaaaacaaccctcctataattaagattatgatcaagcataagtccgaaggaagttgaattctaactattcccccatgatggccatagaactctgtcttttaagaaaccagaagcatcaacattacctactcaaaatgtgtttcgaagaaacaacagcataagcatttgggagtttgctggaaaggaagtcatgggttccaactcagacctactgagtcagatttgaattttaataagatccccatgtgatttgttttcacattaaagtttgagaaaagctgtcattgaggatacagaagaatgctcgagtaacattggaggaaatgaatgaaatatttgaatgatattttcaaaaagtattcagagttccttgaatttttaatgaaaataggcagttgcttttattctgtcaagatcacatccctgagaggctacaatcccattgacctcatagtacaaaataatttacaaaactgtctaaggaaaatgtgtctcagtttgttcttgaaaccattcagccatatgcatgttaatcaaattgccttcctccttatggatagaaaatgacaatcaggattaattgtcacctcctcagaataaacagtaaaacaatttcacctcctcagaataaacagtaaaacaatttcttgcaagtctgacacttggaagaagactatattttccaggtcctcaaaatcttattttgtagttataactcaccatactgtattcaaatgaacagcaagatttaaaacaattctttaaatacttaatgtataacacgagaagactcaagatccagataaaatgtacagagctgctatggagttgaagatttgaaaataatttattttcatggtcatatgtaaaaaaatatatatatccctatatgacagataatttttattttatttagattatgatctattagatagaaagagcactgaattatatgttcccctgatgtggggaatagtgagtatctatttttaactgtccattttactaaatagataatggatatgcaacataaatatgaatacagtaaacatggccctctttatgatttcaatggtctatctttaattattgtctatttcatagcttccttatttatcaatgcaaatctgtagtttgtgagaattcctgtgatgccagtgtgacaactacctaacattttattatgccttccataatatattgtaatacttcactcaatatctcggcctaattttaaaaggaatgtacctagaagttgtcacttttttaaagatgacatgaggttttatagttttgaaaaaatttcagcctaatagagctttgtcatgtagagaaaaaaaatagttactgtcaaacttaggtggcagtataaaccaaggttgatcctggtaagctcatggcaaggaagactattgtctcaatagttaataaagacagagaaaatagttgctcgttttatttaaaatggcaacaaaaacaataatagcaacaacaacaacaaaactagcagtatgtgcaacaattgtatggatatctaatatgtaaccttttctgacacctttgcttcacattcccttaaataaggacctatgtcatcagtcaacgcaacattcttaacattatatcctagggcttatatctgattataattgccaattatatctgacaattggtaagatctacaaattgacgtctcatttatatccaaactattttaaatgcaagtatttgaagaaattgtataggtaagaaaagaacttatagttggagttttaacacacattgtttgatcaaatgcccaaaaatccaatcagaattggcacattgccttacaatcaataaaacagtgaattagagttatgtaatagatatgattatattttttctagtatctaagtttagtaagtttattatggacctttctttactgatgtttaagcttaccttgttgaaagatgaaaaacatagttgtttttttctttaaatatgtagaatgcaacgtccttacagattaactaagcttcagtttataaactcattttcatttcattgagcccctttaaaaagttaaaataccatgaaaagttaattttaaagatgtttgtaggtggcagtagttttaaaaacatcacttcttaacagttttctccaaaagaatttttctaaaccgtgttttcattttggaagaaaagatcaattatgaaatatgtgcttatatttggaaaaggtaaagcttacagatggaaagaaagttaatatacattaaataatttatttttattaacttatgtgagctaatccatatatatgtttttttgtgtatctacttagttaattttgtaatctagctaaagactagcttgttttctaaaactcttgtctaaataaagagcaaataatcagagacacttgtctgatagcatgtgatttttcttcacacccagcatgcacctacatggcctggaagcaagggttttgacagagtaaatggagtagtgtctttctgaaaagaagaaaaatcaatgaatccgtattcagcagaagcaccctgttggtctcaattgtccaatgctgagctatcagtttccctcattgaacacagtgcctggtacatttacttttttaaagtgcactctctggataacaaaaaaagaaagataacaagcatcaatactgtaggaagtcccctgtacaagctttctgataaacaaaagttaagaaaaaaatagatcgagcttttccttagtgtggtgtttagaatgagttcagaataatattctcaatactgtaactctctctgcaacatctgtgtaaatttcctgaacagatctttaaatatattgtttcctttactttctttatttctggcacttatagttatcataaaatctggatatagtcttcaacagttttcatctttattcatatacagggtgttgtaatacatgatataagcaaggctgtataatattaaaataatttgtatcacagttaagagagaaaatatatatcaaggaggaaattctttggagaaatttctaaagctaaatagcaatatatatatatatatatatatatcaattttgatacaggtttgctacaatatcgctattcaaaaaataaatatttatgtacccactattacaagataatgcataaagaaggtatctctaactacctctgtacctccacttaaaatccccggctattctatcttgtcactattctgttgggaccatgcacgataaacttgctctacccagctgtatttgcaatgcctcttatctcttgccaagcatggctctgatttctgtatacctttttatttggacaagacattaaaggttcttatcatttccatttcaaagtgatcttagaaaagtagaaacactgaattcagctcttaacaagacgatgccctttctaatattgtccttgaaataacatctgtaacttgccttcaatattttcttctcccaattctgctgtggtgttttcacctgctagatcatacaaaacataactaacattttaaaatggaacctataaaactaatgaaagaattgttttaacgttgcctacaggtttacataaatgctatacaaaacataccattgcaatttgctaatgttactgaaggaaaacaagatcagcaaagttgctgtacagtcatacatcttgcttcatctgattttttttattatttcagtaagatatatgtcacaattttgcattattttactttttaatacaaaattcacagatatgaatgcatagagactctattagattatacgtattggtagattattattatatttaattgttttcaatattagataacattacatgctaaaaaatcatgactttttacttgataaaaagtaaggtttgggtaatgagcataagataacattattaaaatttaaaattattaaattttagcaattttgttacaacccagagaaatgctaatcttacatttttgaataaataaattaagtctggattcttcctttgatttttcactgggttaataatacatcatgaagtttgggaacccattcctcatttcctcattcaaattatgaatctttgaagcagaattattaagaaacacctatgtacatctatgtacattattaagaaacatctatgtacattttactatgtaaaatatgtacaataatgtacatattttaaacttaaaacatatttttaacttaaaataaaaaaacataaaataaaaataaataaaataaaaataaaacttaaaacatatttttaacttaaaacaaattttaagttaaatttgttaacttaaaaataagtcaacaaataaaagacagcaatatgtatgttagagaaagcagctacagcaaagcttcttgttatcagatgcctgtgctccttttcttacttagatgacattggctgtgacatctcaccatgtgtgcaaaaacagttcccagccttccctgcagtggacataaaaagatttgaagggaggtgttatcattagcacataatggaagtgtcactgtttgaagataattatgtcaccagcttgggagatgagcaaaaaaaaaaaaaaaaaatagacaaaaaccctagaaatttaacaaaatcaaaaatcaacgtacaaaataattccttttaaacagcaacaggcaattagtaaaagtaactaaaattgagatattcttagcaataacagcaactcaaaagaggaactaaacaaccggaagactggacaaagtggctgcagtaaaaattcttgtcagtcatgcttaatgtgattgatgtgatatgatagaaaccaacactccataaattaatctaaaaaataaattgattattaataaagagccagaaactttcgtgaatgatttgctaaacattataacattatatggactactaaaaatctttactataggttaactttaaagaaaaagagagagcatctttccttagaagttaatgagacattttaatgtgatagtaataaaaatgatgtggcatttttacaataataaataaatataccactgtagcaaaatggcaatctcagagacagactcaatatgcatgaaattaggcaacatgaataaggggggaaaagatgagatcgtttagtagaagatagaaaaaacaggcaaaccatatgaaaaaaataaaaatgcttccctaacaaacaaaatttacagaaagcaaattttaaaaacatagtgaacacatgaagagataccctacatcatttgtaatcacaagcactaaaagtaaaacaatgatttttgttattattctcctcttagtgttccaaaaattcgtggtgtcaagtgttggcctcaacataaggattgctgcttagtgtgtagatcggtcattctaaaaagcaatctcggctgggcacagtggctcacgtctgtaatcccagaactttgggaagccaaagcgggcagatcgtttgaggccaggagttcaagaccagcctgggcaacatggtgaaaccctgtctctactaaaaatacaaaaattagccaggcgtggtagcacatgcctgtaatcccagctactagggaggctgaggcaggagaatcacttgaacctgggaggcggaggttgcagtgagctgagattgcatcactgcactccaccctggatgacagagtgagactccatctgaaaagtaaataaataagccaatctctcacagttttaaaaattaattacaaacattttgtgataataattttctactatgctttgctatggtaacaaacttccccaaatttcttgtggctcacaataagaaaagattatatcttgctcctactacatgccagttgctggttggctgcagctgtgctcaactctctatcccatgtcttcaagtgtcttcattctgggccgtggactgaagtgggatgccagatctggaatatgtcttttcatggcagaaagaagaaagcaagagagctgtcaggcacactcaatggctcttagggcttcaactttgaatgaaaatagtcattttgctcaccttttatagatcagaaaatcaggtagatacacttcccactggaaagtcctgctagtcatacagcagggggcagagaaagatgggagtaaattataataaacaatattataatctgtcacacatacactataaatcaaccactcttttcctgggtatacccaaaaatgtcaagtaatatactaaagtgacatgtacagtacaagatgttcacgcagccttcttcatgggtaccagagagctggaagcaaacctcatgtttgttcctagaggactcaaaaatagtggtgaattttcatgatggagtattataacagcaattagaaacaatgaattaatgtgcaaataattatctgagctgattctaaaaacacaattatctgaatttatttttaaaaagcagtgtgagatatacgatgaattaaaatttctttttgcacacaaaacagaacattttatcaaataaagtgattaagtaaagaaaggattgcctgtattaacagtgataattccataaattgatgaatatggtgaactcaactatatatcacaaaggtatcagtaattgaaattatctcaaaaattattccatatctgacccaatgagattaaattaaaagacagtagccaaaataaccagaaaattcatatatttagatatttaaaatataatctacatcttaacatggatataatagatatggtaaaactacaaagaaaatccaggaaatattgggcaccaaattctagataatgctatttggaaggagaaggaaaaaagaggagtgaaaattccttgtttcttatgtagctgtttgtgcatactgtttatttcattaattattgaatacaaataatttatctgggaagaatataaaaataaagtgtcatgtaaaaagtttaaaagtatacatttttgtttgtcttttttttgttgtttttatgttttttgagactgaattttgctcttgttgcccaggctggagtccaatggcacgatctcggctcactacaacctctgcctcccaggtttaagcgattctcctcccttagcctcctgagtagctgggattacaggcgtgcacaaccacgcttggctgatttttgtatttttagtagagacggagtttcaccaaattggtaatgaggatctgatttaagataatgaggactgattgataagtatagttaaagacttagaaagaggaaaaaagcaggaaaaagaatgtttcaggaattggcaacactaattaacctattagtctctggccactgaaactttcagggcaaacacattacagctttctgagcccaaaagagagggaaaatctttcattcacatcagagtttctaggagaggtcagtaactgctatcaaactcccacaccaagaaaccctacaaggctacatttctgctctaagattactggggatatttctaaagcttgagatgtagaaataattaggcacaaaatagctgtaaaactcccagacattcagtacccaaaccaagttgggatgtttctctttttccaaatatcttgagggctatattgtgtctgctcacgtattgagttagggtcttacacgtggcttctgacactaaccttgttcaaattacccttgcagcttagactacatttgaccctgctgcagctcaattatgtttcctgcttccatttgtgtgtgtgtgtgtgtgtgtgtgtgtgatagtacagcttgtggatgatctatgtaaaatatacatatacactggggaggatatatggatatatattaggaaggaacagaattaagttacacttactaattatttattgtgcaaagaaatttaggcctgaagtagataccgaccataacctaatgtaaccttcaatttacaggtgaagcaaaataacctgtgttagttacgatcatacacttaataaacagcaaatccagaatccctccaatgttttgacaatccagtgatctttcctccatagtagagggtttcactcaaaattctccatggtattaaatgcttcaggacttgtctaaagggacaaacaaagcagccctctagccccacctaccaggattgatttggggagatttacttacatttgttctattaagttgtaagaaatcataaaattttttgtgaaatgggaaaaaacattgttgtacttaatatttgtctccttgtacttgcacaaaattaaggcatgaactttgcatttattttacatactgttattttaaaaacatctatttttactattttaaaaatctatttaacccttagtatgtgagtagcactgtaaaattctggagctacaatgataatctagacatggtttgggatctctatttccttccagaagaaacagtgagaaataaacaattaagaatgatttttaagttgatatgatatgtacataggaaggccacttcacctggctgatgtatttaaggactgatataatacggaaataaaatggatgaataaaagacagaaacaaagtaattagaaacatgttccaagtagaagaaaaaaattgtaatatgtttcatgtcagagcggagcatattatagaacttaaaattaaatctgaaaggatttgggagactgtaggatcagattgtggagtaaacagtgtggcatagacagctggaatatgggctttgtcatgagattgatggggtttgagtcctggctccacaaagagtacaaccttgaaagtgtactttaaaccatctatgtgtccacttgttcttctgtaaaatcatgttagcaatagtacctgcctcataaagtgtgacagtgctaaagcatgcaccatgctgagcatgagctaattcaaagaaataaagaactggtttaagaaagctggctgtgtacgcagatgagtttacatttgtatcatggatttgtcaattaataacagcatgacctcagctaagacactgaactgtatgcctcctcaatggctttacctgtaaaatggacgatagaatagtacattctttatcgttgtcttatgcgaattaatgactttgtatgctaaaaatattcataacattgtctccacatagtaactgggccagggtaggcaaaaaggcaggatcaagaggtaggattaaaaataacatggtcagggaagaccatgctgagaccgtaacatttgaagagacctgagggaaaacaaaccgtgtggatatttagaagatgaaataaaaaattgcatgcctatatatttctgcttatatagacaggtatttcatgattttttaaaaaaatttctttcttttacttgacacgttttctaatttgttttctgccttttattcatccatcttatttctgtattatatcatttcttaaatacttcaaatatataggcatgtgagggggtgggggggttacctggcatatttgagaaagggcaaggaagacaagagcagagtgagatgaattatagtaggtaatatattctgagatatgacagagtgcatggagaggtggtacagatcacgtttgaaattaaagtcacggtaaagactttaagttattgttctgagtaaaggtatcagggtattggagagttttatgctgaaagagtagtgatcataatcactggctgcttggttgggaacagattaataagtgggaggtgccaaggggatccgtgaggaatcattgcaataaccccaggaacaggagatgggcactgagaacaaggcagtggcagaggaatagaaggaagtggtcagatgtaggatatgttttgaagacaaagctgataacactgttccataagtgggatcttgtcaaatgagaaacaagacattataatattaagtaacaggtgtgatggattgtaaaaatggccacagtggaatatggcagaactgatattgtacaagccccaagcctatgcttgaaaatgtctttcagatatctctcttgctgctgctgggatacctgaagcactgccttggggagaaactgggtcagcctgctccgtgaaaagaatcacatggcacagtagctctcaagcccctgacagacagccagtctcccaatgcaaagtgttttgctgaccagcagctgtccagagactggcaagagagttgttcaatgtagctcagcctcatttaccaacccatagaatttggaactaaatgaatggatgttttattaaaccacaaagtttcgaggtggtttgacatgctgcgatatataattgttacaatggatgatctatacactttttgctgaatttggaccagaatatcactgtctcccaaagattgtgatatgtagtaaaattgcctattatttgtaaatttaaaaatgtttaccctgaatccctaaagaccagggcaatgtggggtggcatctcaagaacactaaagcatgcccttgctggttaaacgtttatgtgttgtttattgtaggatctaattataagtaattctcaatataagtttctaaaactacatattctgagtcagttcctttctcacttgcctagaaggctttcccatccttatcttctttcttcataaatttccaacatctcccaattttcagactcagttggtgacttccttttaatttcactaagggagaagaggggaagattccaaagggagcttcctctgtaaccaaccaacctgtctacccaacatcctgaatctttcctcataaaccatcgtttgccttccttcctgttactttaaatgaactaatctaatttgtaaaatctaagtcagatcagccaacctatttctacacaggatcttacctaacgctcaccttttcaagcacaatcttccattgtgcctttccatttcatctgcattgattttcctctcttcaatgaatctttctccctctttcatccccagttttttaaatctacattctcaaattaaaatagtaagccaatctactttagaatgagtattcataagtatattttctaaagggaagattaacttctataactatgtaaacagatgtcaaattattttaccatttatatataatttaatgtggacagttattctcttatattgacttactatcacaatacatacagtttagagaaactatttgcattttcactacaaaatgtttaattattcagtgtaattacttataacattttaaaaataaaattattggtgacatttttgtccttcatattttgtttagattttacttattaaattattttctctcttgtccttcaaaaacactttacattatttgcaaatgcatctaattagaacacagggaattatgttatgcatttggcagcagaggtataatggatgccagctgcaagatcttgaacttccaaatctggaatttaaaatttctgaaataacaactcccaatttattgctggcaatgcagaaatactgtttattttccatcttgtctgtaataaacacagtactactgcagatactacactcaaaattttagggaaatacttttacagaatgcactggaaattttgtagcttagattctcataaaaatatttttattaaacatttcctttggttcttgcatcatctctttattaagttgtttaacgtttggaacacattaggaaaatattttccagatatgaaagaaagatgaccttccttgccctaattccctggtgggattttctcgtgcactggagaatgatgatgtggttgcttgaaacggtatttcagctgtgctcaggaggcaggaaaatatcagtctggacacatgtagcaagtagtgtgcatgtagagcatcgcagaaattggatgtgtcctggagaagtctatgaatgatcagtggttcagggatgtgattattgttggctttgctaggacaattctgaattaaaataggatttttttctatttccattggagtgaaattcatctgggtagaccatatactctaacaattggttataaaaaagaaaaatatatatttcttgtatacaagaggctcaagaacattattccttaggtagtaacatcatgcccgaattgcaaaaattagtaaggctgactggtagtggagagatatgctccaggtaaaactggaaatttacatatactttttatgtctattttctgagaggtcttgtggaagtgtggattttttgaagaccatggaaaataattaaaacagctactgtaggtagtataacttggatacaagagaccaatatatggaattcaaattaataacaaaatcctagttaaaatttaatggcagggatttaaaatacaatcactcagcatttttcatgaccttatataaaaggctcagccctagaggagaaatagaataatcaaagaattgtggaattgaatttgacaaaagtttacaagagaagaggatcaaggagccaaatgcacatattataagtatacgaatatgggatccaaccatgaggaagaaatggctgaggaagttaagtgaaattttaactgtagtaacgggggagaaatacaatgtatttcaaagaactggagtttataatggagataagtagaatacagcagaaagagaaaatgggagacattttaagaaaacaagcattcgtggtcaaaagaagaatagcagattttgaaatattcaatgcagaccaatgtttaatagtggtgaaacacagaagggggttctatttgtagataattaaactggaacagattagatggagtggatgtatgtcatgaatttaagaagctataaaatagggaagaggagactacagaataaatagatgtcaataattttcaaaaagggaggataccattgaagatggggcatcaactatccctaacaacaaaggcaatcaaaagatactacttgtgtcacactacttgtttctttgaagtctctgacctggagcaacagtataatgtccctttcctatagtagtgaaggatatagtagtttcagggaaaaacagttttccataatatttactcaaggaagaagaccatgtattcaagcacacattgaaagtttgagtggagcattttataatagctagggggttccaataaaagagtacagtgggttaagccagtgactactaagtttaagagcttacagtcctgcacctactgtagcttctatgtgggatggaaaacatcaatcattgttgttgattgttatgtaaaactctcttttattttaatattgatgtcaatatttcaactgctgtaaaattataaacttttatacttggataagtccaccaggagcgagtatttcgctctcagatacaggcatgcttctcaccgtgcagagctgcatttcgcctgggctggctgcatggaaacccgcccttcctcccaccccacctctctagagcctgggctgtgttgctttatatatatatatatatatatatatatatttttttttaaattatactttaggttctagggtacatgtgcacaacatgcaggtttattacatacgtatacatgtgccatgttggtgtgctgcacccattaactcgtcatttacattaggtatatctcctaatgctatccctcccccctcctcccacctgacaacatgccccggtgtgtgatgttccccttcctgtgtccaggtgttctcattgttcatttcccacctatgagtgagaacatgcggtgtttggttttttgtccttgtgatagtttgctgagaatgatggtttccagcttcatccatgtccctacaaaggacatgaactcatcattttttatggctgcactccatggtgtatacgtgccacattttcttaatccagtctatcattgatggacatttgggttcgttccaagtctttgctactgtgagtagtgccacaataaacatacgtgtgcatgtgcctttatagcagcatgatttacattcctttgggtatatacccggtaatgggatggctgggtcaaatggtatttctagttctagatccctgaggagtcaccacattgtcttccacaatggttgaactagtttacagtcccaccaacagtgtaaaagtgttcctagttctccatatcctctccagcacctgttgtttcctgactttttaaagatcgccattctaactggtgtgagatggtatctcattgtggttttgatttgcatttctctgatggccagtgatgatgagcattttttcacgtgtctgttggctgcacaaatgtcttcttttgagaagtgtctgttcatatccttcacccaatttttgatggagttgtttgtttttatcttgtaaatttgtttgagttcttcgtagattctggatattagccctttgtcagatgagtagattgcaaaaattttctcccattctgtaggttgcctattcactctaatggtagtttcttttgctgtgcagaagctctttggtttaattagatcccatttgtcaattttggcttttgttgccattgcttttgttgttttagacatgaagtccttgcccatgcctatgtcctgaatggtattgcctaggttttcttctagggtttttatggttttaggtctaacatttaagtctttaatccatcttgaattaatttttgtataaggtgtaaggaagggatccagtttcagctttctacatagggctagccagttttcccagcaccatttattaaatagggaatcctttccccatttcttctttttgtcaggtttgtcaaagatcagatggttgtagatgtgtggtattatttctgagggctctgttctgttccattgatctgtatctctgttttggtaccagtaccatgctgttttgtagtagagtttgaagtcaggtagcatgatacctccagctttgttcttttggctcaggattgacttggcaacgtgggctcttttttggttccatatgaactttaaagtagttttttccaattctgtgaagaaagtcattggtaacttgatggagatggcattgaatctataaattcccttgggcagtatggccattttcatggtattgattcttcctatcaatgagcatggaatgttcttccatttgtttgtgtcctcttttatttccttgagcagtggtttgtagttctccttgtagagaaccttcacatcccttgtaaggtggattcctaggtattttattctctttgaagcaattgtgaatgggagctcactcatgatttggctctcggtttgtctgttattgttgtataggaatgcttgtgatttttgtacattgattttgtatcctgagactttgctgaagttgcttatcagcttaaggagattttgggctgagacaatggggttttctagatatataatcatgtcatctgcaaacagggacaatttgacttcctcttttcctaattgaataccctttatttccttctcctgcctgattgccctggccagaacttccaccaacactatgttgaataggagtggtgagagagggcatccctgtcttgtgccagttttcaaagggaatgcttccagtttttgcccattcagtttgatattggctgtgtgtttgtcataagtagctcttattattttgagatacgtcccatcaatgcctaatttattgagagtttttagcatgaagggctgttgaattttgtcaaaggccttctctgcatctattgagataatcatgtggtttttgtctttggttcagtttatatgctggattacatttattgatttgcatatgttgaatcagctttgcatcccagggatgaagcccacttgatcatggtggataagctttttgatgtgctgctggatttggtttgccagtattttattgaggacttttgcgttgatgttcatcagggatattggtctaaaatgttgttgtgtctctgccagcctttggtatcaggatgatgctggcctcataaagtgagttagggaggattccctctttttctatggattggaatagtttcagaaggaatggtaccagctcttcctggtacctctggtagaattcggctgtgaatcggtcttgtcctggactttttttggttggtaagctattcattactgcctcaatttcagagcctgtgattggtctattcagagattccacttcttcctggttttgtcttgggagggtgtatgtgtccaggaatttatccatttcttctagattttctagtttatttgcgtagaggtgtttatagtattctctgatgctaatttgtatttctgtgggatcggtggtgatatcccctttatcattttttattgcatctatttgattcttctctcttttcttctttattagtcttgctagcggtctatcaattttgttgatcttttcaaaaaaccagctcctggattcattaattttttgaagggttttttgtgtctctattgccttcagttctgctctgttcttagttatttcttgccttctgctagcttttgaatgtgtttgctcttgcttctctagttcttttaattgtgatactagggtgtcaattttagatctttccttctttctgttgtgggcatttagtgctataaatttccctctacacactgctttaaatgtgtcccagatattctggtatgttgtgtctttgttctcattggtttcaaagaatatctttatttctgccttcatttcgttatgtacccagtggtcactcaggagcaggtttttcagtttccatgtagttgagcagttttgagtgagtttcttaatcctgagttctagtttgattgcactgtggtctgagagacagtttgttacaatttctgttcttttacatttgctgaggagtgctttacttccaaatatgtggtcaatttgggaacaggtgtggtgtggtgctgagaagaatgtgtattctgttgatttgtggtggagagttctgtagatatctattaggtccgcttggtgcagagctgagttcaattactggatatccttgttaactttctgtctcgttgatctgtctaatgttgatagtggggtgttatagtctcccattattattgtgtgggagtctaagtctctttgcaggtctctaagaacttgctttatgaatctgggtgctcctgtattgggtgcatatatatttaggatagttagctcttcttgttgaattgatccctttaccattatgtaatggtcttctttgtctcttttaatctttgttggtttaaagtctgttttatccaagactaggactgcaactcctgccttttttttgttttccgtttgcttggtaggtcttcctccatccctttattttgagcctatgtgtgaaaaagaataaaaagaaatgaacaaagtctccaagaaatatgggactgtgtgaaaagaccaaatctatgtctgactggtgtacctgaaagtgaaaagaagaatggaaccaagttggaaaacactctgcaggatattatccaggagaacttccccaacctagcaaggcaggccaacattcagattcaggaaatacagagaatgccacaaagatactcctcgagaagagcaactccaagacacataattgtcagattcaccaaagttgaaatgaaggaaaaaatgttaagggcagccagagagaaaggtcgggttacccacaaagggaagcccaccagactaacagcagatctcttggcagaaactctacaagccagaagagagtgggggccaatattcaacattcttagagacaagaattttcaacccagaatttcatatccagccaaactaagcttcataaatgaaggagaaataaaatcctttacagacaagcaaatgctgagagattttgtcaccaccaggcctgtcctacaagagctcctgaaggaagcactaaacatggaaaggaacaaccggtaccagctactgcaaaaacatgccaaattgtaaagaccattgatgctaggaagaaactgcatcaactaaagagcaaaataaccagctaacatcataacgacaggatcaaattcacacataacaatattaaccttaaatgtaaatgagctaaatgctccaattaaaagacacagactggcaaattggataaagaatcaagacccatcggtatgctgtattctgttttgcttttgagtctcagatcccaggtcagcccgcatctcggctctgtgtcatttcctttgtgtttatgtggcattttgtctgtgttgctgtgtagagtaaataaactgtttatataaagaaaaaagaaagaattgtcacatgaacaaggtcacagccttaatttaactgcaataagtgccagaaaaatctgtgtgagaccactccagtgaaagaagaagtgaccgaagaaaggacaatgtagatagagtccaactagaaattgtagcggtgaattaaagggaagtgtcacatctttgaaacgaatgaaaagctatatctctgaggaagacgatctaggcttgaatgagccaagagaagagctcacaagtccatgagaaacactttaatagatatcagcatataggatcccattacaaaaatgatctagccaactccaaaacagcataagaacctttgtaaattcagagaaacctttctccaagcatcatgatgtcactaagtcacctatttcacccacacgtctataagccctctttggttggaaaatggagaggaggaagaattccaaaggattgaatatttataaaactaagctgctaaaaatgaactagaattaattactattaaatggtcgatataaatacattggccacatgcaacaacttggctggtgacaactgcacgtcttattatttgttcaaaattattctcttcccaccctgacagtattttatggtaagaggagtattgcaatctgccacattgactttgccttggccatgggtcttgttttgttcaacggatattgaacagaactgacatatgtcatgtctaagcagaaggtttaaatatgctcatatggtttcctgggacctcttcctttctctccaccatgagaacataatgtttcaaataaaagccagtccttcatcctgcattctggaaagacaagatatatgaagcaaagtccagctgagtcagacaatccagatggagaaaaaagtcataactgaatttcagccttcctgtgacatgaggaagaaataaatgcttattgctaaatgcacagagagactgtttttgtttattttcatagcagcataaaagctgacttattaattggtttataaaaatattatatgaattatggttatgattatgcaaattacctttttcaatagaggatcaactctgacagctagtatcattggattctgttattcaaagtgtctctctcttcttgacagtcattaatctttgagacatatacacttggatggaggatagttccacatcttttcttttccattagtctttttcagtactttctgttgcagaaattatctacattgtcatcagctttcagatatatttgttataccgttttcacatagctctatattttctgtctttaccagtttgcccaaatatgagtgtgcctagcatattctttttacataaaataagtcatcagaaaccttgagtctttagggtattaacattgccatttgctggtggcaaaattttttatggaaaataatttataacatttaaattttattaactccaattaatggcagaaaatgagaaaagtaaacaaaataactgagtgcctacaggtgaagtggttctctgctgataactattgaaatattggcattaaattttcaccctaaaatgggataatagtcaatgtgatctatttaaaaactatataggatcatgacttcataattaaattaaatataattctattgcattcaaatttgtaaattgacttattcagccaattcctcattatttgctgctacagtcatttgagttaattaggtaaaaagtcaacgagatgctaccattgatttaataaaatctttgaagacattttttattgctagattgctatggcagaatatttacctcagaaaaattccttcatgtgactctgtgaacgaggtataccacgtatgtctcttaatgtttataatactgggagagaacataaataactgaattatttcttcaactactagacatcaaccactggatttggatccactgcactctaaaggaggccattttgccatcagaccttaacattctcttaggtacctaatacaccaacattgacagagatattagcaatacaggacttgtatagcaagtttaacattgtttaaaagataatgtcatatttataaattgagcttaaactcttgctaaacaatcttaggcatccttaaattcatcagagtggttaaaaataacatcaagataacaacaatattctatagcgaacctataaatgcccaacttctaattttcatgggaagttttactcttcggataatgctacttgggcttctaaatactgaaacacagaaaactctgcataatgaagggataaatatcacagcagtgaaacaaatgaggtcttgatttctccttttattgcaatgccctgaattttgtttatatataaaaaataaaaatggctctctaatttttcccctttaaaaaacgttatgtggaaacacttaagtacaaactttttttcatgactacattttaatgtgacatcggcctacctcttccacacaacagagtgttcattaaagtctgcaagatgctgcagcaaaggtcttctgtcaaggtttctgtgcatttcccctttggtttcacatttttaattggtttaaccaaaaagaacataatctctacctcgtaacaggaagatatccaagtttcatattagttttcttatctctagtggctatctccagcaatacagaatactaacaaacaaaaatctaaggacctcagtgactagcaaaaagagaaagaaaatcatttttggaaagttttactaccagaccacatggttccacgcaattttctctggtgtggtctcaaacatattgttaagaagacttccaatgagttgaggattttttttgttaaggcactatattgtcaagctgttagagtaatgcagctgggtctaaaatttttggctttttagtcaaagctgaacagtgtccatagatttttctgagccacttccaacatacagtagcagctgctgtgtttatgtgcaataccactgtgcaagcggcaattaaactacaaaattctagatacgtagttgggaagcagcaggcagtcagcacacaactggcactgagctaaaacagaaaagattcttacttttgaaatgtaagtcaagctaacaaacccacgttgctgtgtacagaaaatggtgagtaacaacaaatgctacttgataaaagaggacaagaatcttctgcgtaaaatataaattttgttttcatattttccacatgtggcttcaaaaaataattacaagcaacatgacttcttttgatatgttataaaataattaatatttaagatacacttcttataataaggtattacttgagtgtatatcctccatgtgcaaaatcctaatagtcattttattagggaaaatgatttttaaataattacagattttccttttgacgttgggggcatatgaataaggatgccaaaatatctcagatgaaaaaaaggcaattattgtcacaggaatttcactttctgcgtacttcctatcctgcaagttttagatacagtgtaaaaactgcctgaaaaactaaatttagtggacatcacatttcagcatctgtcattaaccccaaatgggatattttctctgtgattgactgctttctgggatattaactggaacaacgtcaggtgagcctggttacccttcattaatgtagtgtccaaagttataattttccatatatgtttaaataaatcttttcgtgctttaaggagagtatgccatcttgccatatttgggaaaaataatttacttttataatttattggcttattaaaggatataaaataaactgttgatttaattcatacttattccatcgtctaatgaaagaaaccttaaatacaaatatcagagatgttgtgtttgtgtattaatgtaacacaaaacaaacaaaaaccacttggtctctttccgatatttcaaacactcctggaatttcagttattatttctatctgtatctcttttcacttcagacactccataatatcattgaattgccctgtttctagcatcaacactaacagggaggtaaaatataggatatctacctgaaaagattccaaaagagctgaaatttgatcctatctaaataactcattaattgtaaaaccttgagtggtcatttaagcctgattaaatttggcaatttttaaataattaaacctatgacgctctaaagagtgtgtaagacaatttctcaaagtggggtacaattaccctatggggcattgtggatgtggctggagcaataccagatcaattgcaaggcactcctcatcgttagaggccacgccttcctgtttactgctgtcttccattcccccacttcatgtctgccatggagtaggtactcaatacatgtttgataaatagagattgaagcatttcaaatttggagagtgccaatttaacaaaatgttatgtagttgcaaaagattttttttttttataaaatggcattgacatattatttagtaaattgcaatatatgaatatttattttttgagacagagtctaaccctgctgccgatgctggagtgcaatggctatctcagctcactgcaacctccgcctcccgggttcaaatgattctcctgcctcagcttcccgaatagctgggattacaggcacccaccaccacattcagctaatttttgtatttttagtagagatggggtttcaccacgttggccaagctggtgtcgaactcctgacctcgtgatccacccaaatcggcctcccagagtgctgggattacaggtgtgagccaccgcacccggccaaattattttattttattttgtttatttttcatttatagtgattccaattgtcatgcctcgtaagacatttaagaaatggaagtttacacttgggatggggattgctaatttggccctcaaaatacatttatctgttcttttatattaatccttttaagtgagctgcccgtttagcaaccaagtgtttcaatcttcatgttatggaaggctgtttgtgttgaccaatatgcagagctcctctttttcgtgggacacacgtaaactacattcactgagcccccttacatcccagtgccaccatgtaatgtgtctgggacattggaattgacatataccaatttccagcctaaccttggaaatggcccatgaaaatgtcctcccactcctgctcattgctcaattagataccaggaattcatgtaagaccccaagactctaagtggaagtagaaacactatacagagcatctgtgtctctgaatgattacatggaggagaacctttcagaagacctatataaatgagaacacatgcctttgtttgagcagggaataaaacttcactctattaaactaactgggatattgagatttctttattcctgcaaagaagcttagcctaccctaaataaagcaaatttgtacccagaaatggggagctgggatatcaaattattatgtgtcattggcttaatgttaaggtgtggaagataaggaattttatattgaaacttgcaaagatataggttatgtgtcaggaaaacttttgataaaatcatcaactttgacagcataaaagggctaggtatatgccattgtgctggaagccataagccaagaagttggaaaataatgccacagttgtaggtgttggctagaattcactatttttggaaaaatatgatgagaaagatgagtttggaaaataattgaatgatttataagtaggaaaatacatagattataaagcttccataaattcttgaactttcagagttagaatatcatattgttcttacacttcaaatagttgaaatgaaaaatttaagtctttgaggctgggcacagcggctcacgcctgtaatcccagcacttcaggaagctgaggtgggaagatcgcttgaggccaggaatttgagacttgcttgggcaacatagtgagacaccgtcactacaaaaaatacaaaaatcagctgggcatggtgatgtgtgcctgtagttgaaactacctggaagggataccttgagcccaggaggtcgaggctgcagtgagctatgatagcaccaccacacactctagcctgcgtaaaggagtgagaaccagactccaaaaatagtcttggatagcacaggactagtaacatttctcattgaacaatgtaatcaagacatacggtggtatgatctggagaaagtggcactggaacaagaaagaaatgaaataaaacatatttgaaagttatgtctaagaaagaaatgttggattggttagtagcattgaaaggattagaagagactgttttgagaggactgcattgcctaagaaatgaggagcccacgctaaaataaaaatgtctcttaggtcaggcgcggtggctcatgcctgtaatcctagcactttgggaagctgaggtgggtggactgcttgtggccaggagtttgagaccagcctagccaacgtggcgaaaccgtgtctctactaaaaatacaaaaattagccaggcatggtggtggtggtacgtgcctgtagtcccagctacttgggaggctgagacaggagagtcccttgaacgcaggagaaggaggctgcagtgagcagtgatcatgccactgcactctagcctgggggacaagagtgagacgccatctcaaagaaaaaaatgtctttcgattatgacactcagagtcatcaggctccagccttacaaaggcaggagtgggctgtgaaaatgaagaggctgctgacacccaaggtgtgaagcagcccctcactactgctgaggagggatggatatgctggttttctcgcaggcttctgctgataccaccctactgggcaccttattgccgatactatggagtcagcagttgccttgttatctctagctagagatgaaagccctgagcctcctttccacatgcctcctctgatacgacccacttataatgataagcttcactatattcttgatacctaggaaacagttcaatgggaatattttctactataatataaatttgtcaatttcttcctgtcattctgtcaaataatacgcaatgaggtgtatttcaatttaacattatattatttttcctggtaatttttttttatcataatgaaggtagtgaccttcatgagatactacccacttggagtaggtggcaccttgttcctgccgggtggagcgtggacgtccaggtcctccgtgtagtctccgacactgtggaaaatgatttctagttgccctggcagggctgaatgtcccagttccctattcagcctaccctgagaccaccttagtggtggatggtggtatttgggtcacctcattacaacttgggaagtgtggaagtccaggatccccaggcagcctttgtgggtgtggaagaggggtaagggttgaggtcacattttgttttctgtgttttctgtggctagagttgggcagtattgactgtacattttctgcatggctatgcttccattttctggtcagctggctagagacagcaagctttatcggagcctaaattggcatttctgggtcgtcagcttctcctgcacacagtctggggcacaggaggcaaaatgaaagctcagagcactcaccagcacatcatctttggctgccgaggtccctggctggtctgccatcttccctccacttttagagtcctcttaaacactataacatattaagtatttttagttgaacttaagtaaagatatagggaaaagtacatctatctcatctttctagaaatagaagttctataattttaaaagtattatcatatatagtgttattaatatcaaaatgtttgaggtcagaaaaattgtaatatgagtaagttattttacaactgagacatgtcaacatgacaatctagaattgtcaagtcgattgttagaagaaggttctcaaggctggggatttattgcatcctacattgcttcaagcttaacatagaattttccaacccatgaagcttcactatattcttgatacctaggaaacagttcaattggaatattttctactataatataaatttgtcaatttcttcttgtcattctgtcaaataatatgcaatgaggtgtatttcaatttaacattatattctttttcctggtagtttttttttaaatcataatgaggtaatgaccttcattagccttattttttttatttaacattcttcaatcttctgtgttaatacagcagcattaactctgtttcttaacttttaaatttcaatctttttgtgttcttgtaagtggtgtatagctggatttggagaaaaaaatctaaaggtattatcttctttgtaactggtgagctgctatcattttggatatttttttatttgttacttccatccacttttcccactgtccttaaccctgctttttctcttttttttccatcttaccttccttgtaattgattggggttagcatcctcctttttactgcctttattttgaacaactgataccatatttctatttcatagtgattcactttaaattgctgttatttaaatttaacttttattattattattatttttcgagatggaatctccctcttgttgcctaggctggagtgccatggcatgatcttggctcactgcaacctccacctcccaggttcaagcaattctcctgcctcagcctcctaagtagctgggattacaggtgcccaccaccacgcccagctaatttgtgtgtgtgtgtgtgtgtgtgtgtgtgtgtgtgtgtgtgtgtgtaattttagttaagaaggggtttcaccatgttggccaggctggtctcaaactcctgacctcaggtgatccgtctgcctcagtcttccaaagtgctgggattacaggagtgagccactgcacccaggctaaatttaacttttaaaagcaaatatcaccattatgcttgttgaaaataattggggatcttagactccttcaattcagactaccaacttctgtggtacatgctgcatatttcagcattataattctacccattgcatattcatcatattagtcattttcttattgttacttctgcctccccatgtcaatttttcctcttgaatctttcatttaggatccatgttttttcccaaatacttcatcactattttccagttttatagtattagaaataatttcccttagtctttttcgaaagtgactttatttcatgaactgttgttgagtcatggtttcattgcacaaaattatactatttttttctactgtcagcaatttgaaaatgttagaatagtttgtaccatacataaatttaagcatactcaatattatgtggcacattacactacctcactgtatttctgtgtgtttttgagaatgttgtaatttaaaagaagttcactccacagccacctaattcctctgacttgagttatattcaagtgtctcaaaatgtgacacagacattatcttgctacttgccatgcccttaccattgacattgaagagtggtacaaatgcagtcactcatccatctccttgctctaattcatcctaggtcaactgaaaaagtgtttgatgacaacttgcagcatagagacagagaagacacacgggcatatgctttggactacaaaatccctaaagtgtccttccaaatgttaaatgaggattctataaaagaagcaacaatgttgattatttaattatagtattgaaagaagtgctatagtgagtcaacttggctcacaatacaagacacttgaagactagagcatgctcttgggttcttaataaactgtgatctgtttgtacctccaggtgaacatggttgttttgaccttattgaagtttacacctttacctgttagtgtcctttatcttctaacatctattgttgcctttgaaaaatctgttgggaattttctaagtctgatcattcgtaaggtaacttttctttttaggttatgggttgtttttcttatcccttatctttttctttcttctctgccttttactggtatatatctagaaatatattttaaaatacttttccagacttcataagtttttataatatgagattatatgtttcatcaactctgaaatatcctcagtcattcttttctttgaatactgtcttcctaattctctttattgtatccttctggaattcttttccaaagattctctggacattctcatttcttctccatgtctctccaattttcttatattttctttatttctcgatctttccttctaagcaaagcttgtgaaaattaatgctattctctttcatgggctcttaccctgggatgtcagttatatagaaaaaaaaagcaatattcaagaacgagaatctattcttggtctttggagatcaagtcagtgttaatttaaatatgagtttattggccctattttccttcagatttagagggatctgtgattcttttcaatgctgcagcaatgtgtaactttcctagccggaaaacagtgcacttttccctgaaaatgataactcaactctccataatgtctctttctagtatcaaaattacatggtatataagttccacagaagggtaaatatgtaagtaatagcatacaatcttaatgattttaatcttattgaaacacttatacaagttaaaattttagttttgctcttgcttgtaattttgtggcaaattttctccatttttttctagatttgaatggaatttaaaaatatccctaaactgttactttatgattaagaatatgatcattgagggcaaacaagaagagatgattttacactattgtcatgaggcaatttttcaaaagacaatttttaatgaatcagcaattgctgttttgatactataaaagatgcaatgtttaagatataactcgcttttcaggaagttcatgaggaccttcaattaatacagtaagaacaaactaataagacataagatgtttaggaaaagaaatatgcctcttgagttctcatcagatatacttttaacagagttacaaaaaaagaaaaccttaaattccttcatgtgcataatgaaacactaacgatgttatccttgagaagatattttttctgtggaatgtatccatatggccttcaaattcttgaacaccctacaatgacattctaatcgaagaacaacagaagagaggtcaaagaaaataaagctttaaatagtccaagaaatttcccacattttaaccttcatctgtagcctccatttttttaccccttctctcagtttccccatacaagtttatctgagggtttttccccactgcttcccacctttttcctcttctgctttatcctgtttaagctacaatgtctaatgtctacagttctgggtacatattgtgagacatatatatgttgatttttctttcacagtgcaaagtatctaaatagaagaagctatttttgcaggaatgatatggccttttgctttctgttccctggtcaactcaaagtaaagatagagagctccattaaatctctttttaatcgtgtaagtgccctgatgcaattgtctcacaatacaaaaccattatgttagacataaattaaggcatacacaagacattacaatggtatttaaagtgaaatatttatgaagtgatttaaatactaatgacacagcattcctaaaggagtcctaaaggataagaacattccacaccagcattttagtccctcagtctgttgcatgttgcatatattgtttctcattactcaagtttgtagaaatgtaaccaggagatagaagagaaaaagagcttgtggggaatgaagaattatatttgaaggacatgccctctctttttacccttgaatattaataccaagtccgactttacatggtttacataagaagctccttagctccttgtgcagtaattccaactatcccagacacagtcttcacctttatattggaaagaatgtttcctgctctagatgactgtaaacaaaccagcttaatcctgccgttcttcaaatccaacttatttgcagctctctatcctgccgttcttaggacgctggtaatcaagttcctcattattgagttctagtcgtcacatgcagaaactacaatgtccagaaaagacaaacacattcctttctgtatgtacctgttttatcaatgagaaaatctttcccagatgccctccagcagacctcacctgattcccattggctaggtttaggtcacatgtgcatgtgatcttatccagtaatgatccaactcctagtgggacggttttcctgtgcacatggatcagtagatggcaattaatcacacaaaaccaggactattgccaataaaaagaagagggctggggaggcttctaatcagaaacctgactatacctgccataacccccgagcatttttctaaaattaagtaaaataatccaaaagagaaaatagaaattcataaaacttaattaatactatttccaccattggtcactgtatagtctcctaaggcattactgttcatttattctttatttactcacagctctaacatgtggtaaattgatgtcttaaaacttttaacatttgaaacagcaatatgaagatgagatgaaacagactaaagcaaacatcttactgtaccaaataaaattggatcaaatttacaagcccagattaaaatgttaacaaagaaataatataacaaaagggtcattttgcacaggacagggatgaatgttgctttgtactgcaatagctctttagctatcactgcataaaaatcaaatgtaatgttcgatgctctagataatacttctaaaatatatagagatatatatttcagtcagttttgaacattgttttgaacattgtgataaagaagggagagcaaatttcaagactaaatattacaagaagatataatttaatgtttaaatttgaaggaaaaaactacattttattggataactcctcactgcttggttgatgatctcatttaaaatatgtgtattgtgactaaaatataaagcagacaaaatctaccactgggactactttaagagtatgtgagtagacatacttcattaatgaatgctactacacttagtaattaaaaaatgaaaacaaaaaagatgtaatattttgatgtgattctctttaaatattttcatgtatgctattatgcttagtaaatcaaaatgaaaatgaaaagaaaaaatgtaatattttgatgtgattctttttaaattggttgttttagctttcatttaaatgaaatgttttcgatactgaaaaacaaagattttctctaagcaatataattaaattcataagataaataatttcaataattatctcttaaaatatcaacatctcatatttcagagctctcgcattttagagattgaatattgtaaatgtaactatgcaaatcgacttaagtattaaaaacagtatcaaaaatagtaagatcttcaaggtatgataggttacgttctctggataacaaaattattgttttaaatgactgactagaaaaagggttaatatttgcattacataaacagaagatgccattaaatcattttcatattattatttgaatgaagtcagagtatatataaattgaaactccctgaaagaaggctgtgttgggacactgagaatgtggcccaaccaaaacttatgtgaagaaagtgattgaatgctcctgtagaactattcaagtagttaatatcctacatcagtacatctgaagaatatttttgtctatctaacttcactgatcattggcagaacttaaaacagttactctgttaatgttaaaaagataaaagatctgaagtcaattttgagctaaataattcattggtgtggctgagttactcatgatttttgattctttagttttgtttttgttttttcttttctctcttgacagcaaaaggagtgggttgagctaactggtctctcttctgctttgtcttacactgtatttgaatgttttagttattttgttagagctcaaacattcaaagacagtgtaagaaaaacagaaggtctaaacattagtcatgttatacatagatatttatgcaatatctacatgtatttagaactgaataaggcttgtaagtttttattccatatcacttatttattgggattcattatgaatatctgataaattagttaataactagttaagaaaagaataaaagaattttaaaatctagtctatcaactgtgaagaagaaaaagaaaaatatacggctgatctatatccttttgaagttagtatgcaggaaaaaactttaaactccaaaatatccttaccaggagaaatctattaagtcacaatatattgtatgtatgtcaatctctctatacattatcggtctaagcaatgccttgtaacttgttggaattatgcatatatgttttcaaatataccatttcttctgccattcaaaatgagactttaatgtagttagtaattcttctccccatacagagaaatactattaggctgaaatcatgtaaatgccttatccaatgttaagttgctccctccttctatagtatttcgaattaggaagtgatagtatttgtgcaatttatgattaaatccaatcattgaatacaagccatatacctcaaggcaaagaacagagaaaaaataagttataaattgttttccatttgacctgcagaattataaggtaatgaaagagcaaactcattaagagatcactttatataagagacaggactgtgcactttacattaataatctaattcttataacagaatctaggaaataggcatcatcattttccgcattttacagataagatatctaagattcagagaggctgtgatattaacttccttagggttatatagtaagtcaggtagattttaccttttcaagaaagttcattgtttactctaactttagatttagaaaattgcaatttataatcggataggccacacaagtgcatttttaagggtctagaacccttaccatatttctgaaggaaatccatgatgtatatgtagatataaatatagatatggatatagatatactgagagtgagggagaaaggtgggagagaaagaagaagggaggaagaaggagcagggagagaaaggagagagagaaatgagaaaggcagagaagtaacaggaagaaaagagaagggaaggcaaggggaggagaggaagggagagaaagaaaacgggaaaggagaggaaggggaaaagacagaaaaaaaaggaggggatgaaagcagatgactaatatggaattttcacgtgcaaaaaggaagaaaaagtcacatggtgaagaaaacatagagtagatttggaacaggaaaattgtaactcagtgtcagggaagcccagaaagtacagctatttctgaaatgaagacatctagacctttacatggttacatttgtttcttaatttgtttcagtctagagcatttcttttcagtttctttaattcttttgcatattttcagcattaaatatttcctaacacttttcagcattaaatatttcctaacattttgcctctattttcccctgctactcttctgttttgaaaactttcaaagcgcccttatagactgacagaataaactccaaatgacttagcttgcatttgaagaccttcaaaatctgcctcaaactattttttagttagatcccaggactgtttatcactaggaccgaataaatagaacatttttatatatttccaaaaacatagcacattttgaaaatttcaaaaattatttatattttaaaaatattcttagtttcataaatttttattttaaaaaatacacttatcacaatgagaaaatgttatctccggaagtagtgtgtcatattttcagtaaatagacagatttaattaatccagataaaggagagataagggtacagctcctttgtaattttagattcaccacagaatagctcaaaggtttatgctcaatgaataatgaactttgtattttgcctcttttgagatctcaatactggtaggaaactatattctatggatccatttcttatgttttaaattcgtatgcacatgatcttattttatcatgggttgttggcaaaataaaagaaatctacggctcttcatactcttcctgcaaaaatgctcttgaaacagctgcagaataccaataattatcttggtcagttccagtgtagcaaagtcaggcagctagcatttatctccttggctaacaagtagcctgcataatgaaatgtaaaatagagttgctctctcttacacccaagactggctcatcctctttgcctggataaaaaggaactttcaagtacaaacagctgagggtttgtcacagctgtagaacaacaactctggtggatactaaaccacgctccaaccacagattttcatttaaatatagctgcaaaaattgacatctgacgatatggacaaaagatttcaaataatctatattaaaccctattgaaatccatctgttaccaggtgttataatgaaaatatttctgtaaaatttcttagataatatgataatataatactttttgaaaaatacttcttttctataaacatgttgatgtcaaataaaatattctgaagttttgctcttcagaagaactcttgtccatgctaaaacaagctgataaaatatcagcacaaattatatttctgtgaggcagtataagcaattgaagggaatcaggtattgactggctgcagaaagcacagacacaattatcttagggaaaccgtacattgatacagagtcccgaaaagaatgcaggcatggaatggagtgagggggataaaaatataatagttccttttcagtggctttgggtaaaagttacatagcattgttgaagaaacccttggcttttctacattctgtggaatacagtaccctgcacttggggacaaaggaaggaaaaaaaagcatagattttgtccttatgggatttacaactgtattaaagaagccaagtttttcatttaagaatatatttatctatattaaagaataaaatagatagtaaatgaaaatcagctaccatataacaggaattatatattttaattttatacatatataattagtgaggaataacagattgtcaaactgattccttaaaggaggcaaaccttgaacctaattatgaacatgagtaggccctgttcctctgattgtatctgctatgcctttcccccttgctctccaggttccagcctcatttgttcttgactctgtgtgccatgggtaacccaggagctgagacaaaggcccttgaagtaatcagacttctcaggagagagcactgctcagctatggctggtatctttaaaaggatttaaaaggatttttaaaagctggctctaggagtgcagaagaaagctggagtgttgaaacttacctattgttgctcacatcacccctccaattatctctattgagaatcagaaaatcaaaactcagataggttaagcagcttgcccagggccctagactaagttccaaacaccagccgtcgagttccctggtttacactcaatcatgctaggctagatgtgtggtttttctaaacacatgccatataagctttcttgtattgtcacatctcagatagttattgatatctgtgatattagatgttatcttgggaatagagagaggatgagtgctataattgtccctaatacatttcaccactacattttagcatttctcacaagacagttgttagtaaccgtcggactttggaataaagtgctacctgaatcaagagttagtgcaatgctgaaggctttgacttaagactgtcaggtcagaaaggtattttttgtcaaattattataatagtgctccaaacttaaaaagaagctaatttacttccaatgagaagctgaagccatatttgttacaactgttaattgcttttttaaccctttagtaaatcattagtatggatttaggctattcacaaatcaggaactaaattgcaattcagggagttactgccagaaatgtgtctcagttataaaaataaatacaattttcattacaggaaaaaacatgtttataattctacatttaaaaaataagagaagtgaataaggtgaccttaatttaaatgctataaataataccaacatggactgacatgacatcccataatacctttatgcaattttttcttatattattaatgttttttgtgtgtatatgtatggtgtagataaggataattttagtctcaactttgaaaagcattgaaaatgagatttattgaccatactttatgttatgtctacattcacaaaaggtgaaaattacttcataaaatctaatctctacttattctctcttgatccctatttatctctgttatggtaggatgctttcacattggatgattataaatacttaatagcagcttttaggcaagttattttgaatttgtagcatacattttgtaaaatacctgagcattaagccaataaagcatgcttcacttctaataaataattaaccgatgttataggtaaacttagtaatcaactatttaaattattaataaatagtagattaatggatttacacattaatacagtcatcccactctattacttactccttccaatgttatatgtatttgtctcagcccattaaatgcttgtaaatgaagaatacatatatatataattccatgttttgtacatcaaattacttattaaatatatgtgtaatatatttaaattattgtttaagaaactttcaacctatattttataaatgttttctttttttcaatactttgcacattaaagattcaataacgtgtgggttagggaaaccctataataataaagagaatacaatgaatttatatagcattttttataagatgctcacagtactttcagtatattatctcatttgtcctcactgacttttattaaaaaattgtgggggtgacatctcatttattctcgcaacatgtttattgaaaagcttttgtatttctcctgtaaactagtaagttttgttacccttgaaaaccaatttttgtcaatattgttggatagattgaccagttttcaatcaatatttttacataaatatacataccatgtcagaaacaggaagcaattaaaaagtaactgttttgacgctatgtctttctgttcttaaaatttttcttctctttcatttagcatcttcactctttctctaaatagttgccaacataatctgaaatacagtgtacttctctatcagcccgaatatattctttaacctaccccattttcctcttttcatctttcaaagcccttcctccagaagataaatatcttttggtaaggagtctattcctgtacggtattctcctcagccctctacaaaagcttacatcatctgttcttgttttgctgtacatctttctattctgattaatttccttggtaatgaacttgaacatttctatcaatttcagatgcagaaaagaagcctaaaaatcagttatttctttgccagttttttaaaaaataatttttaaaaacattacatttatcccccatggaacatttacctctactcatatccaggtttttgtatctatttatctctctcctgactttattagtaattatttccaataattgaaattatttattatgtactttggataaataaatgtgtcctgaactcgtaaattctttgaggagataaattctcttcaaaaatgtttaattcttattcttgcaaatattctcaatatacaaggtttttgttttgttttattttgttttgtttttgaaaaagtttctcgctgtcggccaggctggagtgcaatggcaccatctcggctcactgcaacctccacctcccaggttcaagcgattctccggcctcagccttctgagtaggtgggattacagccactcaccactacacccagctaattttttgtatttttagtaggggtttcaccatgttgacctagaccagtcttgaactcctgacctcaagtgatccacccgctttggcctcccaaagtgctgggattacaggtgtgagccacctcgcccagcttcaatatacagtttttgatataagactcagtgtgcccattttaagctgccggagtttcactgagggtgttctgacttaaagcattttgccaacagttttattcttgttatatcgctgtcctagattctagagctcaattattacatattttctcttatagtcttttgtatcttacattctcacatcatatttccaaaggtagagtatatgcagtcagctcgaaccacagcttctgcccctttcattcacctatttacctcttgctctccattaagtctcaatttagctatcatttcttctacaaaacccactctggcactttcaatggactctgtattttctgggtcacaacctttctcatgctgaactcaaataagtagtgacagatttaatcctagcatctagaattgtacctggctcactgtaagtgccaggatatatttaccgattgaataaacgaacgtgctaaattcctttcagatgacatattaagaaaagcactttgctcaaggagtttgcaaatttctgctagttttactacatgttcagcatgaaaatgttaatttctgaaaatacagagctgttttacttatctgtgtattccctgcagcgtctattatggtattttacacacagttgattttaaaatattcaatatgtataaatatataaacatatgtttaatttacctataaatatatttaataatgtttaatttacatataaatatataagcttatacttgattttaaaatgttaaatggagaagtgccaatatcatatggaaacttattacattagctaagagtacaaactcttgtttctgtatgtgtgtgagaagcatgtttttgttttccccagatctagttttgatatgttattttatttttgtttatgatctaaactttagactgattctcacgtatccctcatgaagttttgagaaaaccagtttatcaatttgcagtgaaaaatgcaatctagcacagaataattaaattagcacaatctcttcagcttatttctgtaaagagatttcaataaaagccacactataatcaaaacataccttgatagtatgaatacgaataggaataagaagtcaaaagcaaaaaactgcttattttcagtaccaacacgcagtgttgtattcatctttccagcaaggatgctggcactggacctgaagttaccgcggcagaattcagagctctttgaaattagcttgaagagcgctatgctgctatatctaacatattcaactcatcaaagtaatctacaagcagattttaagtattcagactcaaaatacaaaagaagaaggcgcctgtttgtgttcctgacttgcctacatggtagtatagagtttgtagatttaagaatgttagagtataaaagaatattcaaattgcttcaaacaaagggtttcctcaaggggagtcacataaagaatttaatggagaaaaacttttaagttgaaataaaattggcagcaattatttttatcaaagagaatgcaggctgacatcagcgtcaatttctttacacaggaagacctctgcgcacacagtcatttgggtgaaccaaacaggaagagagaaaaataatgcaaatcagagtgaaagaacagagataagtaaatcatctcaccaacaaagtgaaacgccattactctataaaacttaactggtgacaaacacccgtctttggcaaacaagtagagtttgaattcaaatatgaactttgagaatttgcagataaaatcggtagcgtgaaaggaaaataaatctcgggaccccaaactcagtaagtcaaagggaaaagttaggctgggaactgggtcacacaaacctacctccccttttggttcctaaataagagggctgcaagatgaaaagcaacatgcttcccctgtgttttgtccccaaggaaattcctagtgagctccaaaatctttaccctaagctgtttctgttaaaagttcaccgtggcagtgtagattgataacttatctttacaggtgcagttacccccctacccaccagatacaaatgcacatctgattgctcccctgccccattttgtctatgttgtcttatgtaaaaatgcagattccctgaatatttcctctgccccatatgtctatgtcatcttacgtaaaaaatacagattcaatcataaacaaaaggtatctagagccatggaggaaaaggcaggagcccccatacagaatttctccatgatttttttttcaggaagagaagccttaaaatgctggggaagggcaagaatcactgtcttcctggaaacactctcaaaaccaaagccaaagagaatattgaggacagccagaaaaaaaaagacacactatatgaatataaaacaattcctttttttgtcagaagtcaggtgagccagaaaataacttaaaatgaactcacagctttaaagtgaagaaagaaagaaagaaagaaagaaagaaagaaagaaagaaagaaagaaagaaagaaagaaaagaaagaaagaaaaaggaaggaagggaggaaggaaggaagcaagggagggagggagggaaagaaagaagaaagaaaaagaaagaaagagaaagaaagaaacaaagaaagaaagaaaggaagaaagaaaaaggaagaaagaaagaaaagagaaagaaagagaaagggaaaggaaaggaaaggaagaaaaagaaagaagaggaagaagggaacgaaggagggaaggaaggaaggaagcgagggaggaaggaagggagggaggatggaaggaacataaaccaagaactctatgccacagggaaataattttcaaaaatgaaaaagaatcaaagattgtccagacaaaatggcataactgtcatcagacatgatacttcaagaaatgttaaaacttctctggccaaggaaatataatccaaacagacacataaacatacacaaataaataaagagacccagaagtaaataaatgaagatagagtaaacttactcttttgtcgttgttgcagtaaagtgtaattgtctataaaaaatacttgtaataccttgtatcgtgtttcaatagcacatgtaaagtaaaatgtgtgacaagaatagcctaagaataggagagagaatctgggactctcttattataaagtctttacatgtgaaacagtataatgttccttaaaagtagtcactaattaatagtaaatgatgtaaaatctagggtaactatagtaaaaattttaaagaggtataaataataagccaatagatgaaaaaaatgaattataaaaaatccttaaaccaaaagaaggcaagtggaagccgaaaaacaaaggagctaggagagcaaaacaattctgaaaaagaagaacaaggagaattcaaacaatctaactttcaaatttactataaagctacaataatcaagaaaatgcagtattagcaaaaaaaaaaaaaaatggatatatatggattaatgaaacaaaatagtcctaaaatagagtcatgaagatctggtcaactgatttttttaatttgtatttcaaatgaactttgaaataattttaaatttataaaagagttgcaaaaagagtacagagttcttgtatacctcttacccaggttcccctagggttaaaaatgtacattgccatggtacatttatcaaaataaagacatttatattagtacaataatgtaaactcaacagtttgtttactgttatcttttttcttatttttaaataatagtccattttttagagcagttttaggttcgaacaaaattgagcagaaggtacagaaatctcctacaagaccctcaccacatgcaaagcctcccccattgacagcatcccaccagggtggtgcatttgctgtggttgatgaactctgtagacacatcattacacggatccactttcatttaatatcccagaatccaaaccaggatgccgtgttgcatttagtcacgtctctgcagtctcctacaatgtatgacagtttcttagtcttcttttatttttcatgaacttaagaattttaaagggtatcccaggtattatttagacttcttgggggtttttctgatatttctcataacttgagttatgaatttggggggagaatcacaaagagaagtacccttctcattgccttatattatgagggacacgatatcaacatgtcattactgatgttgttaaactccatctcttaatgtctgccagttttcaaccctgtgaagttcctttctctattctatttattggaattgagtgttttatgattttaagattattttgatggcaggacacaatatgataacactcatagatgaaaaggcagaaccttttgttacagctaaaaaggagagaacctggctgggcatggtggctcacacctgtaatcccagcactttgggaggccaagccgggctgatcacctgaggtcaggagtttgagaccactgtggccaacatggtgaaaccctatctctactaaaaatacaaaaaaaaaaaaaaaaatgccaggtggtgcatgcctgtgatcctagctacttgggaggctgaggcaggacaatcacttgaacttggggagtggaggctgcggtgagccgagattgtgccattgcactccagtctggacgacagagtgaaactcagtctgaaaaaaaaaaaaaaaaaaggaagaaagaaggaaagaagaagaaaggagagaatctttccaggcaggtcattcagggggttacaccctcagggacaaggtattagcaagctgtcactgtaggggcagcttatatatggcaagcaggatgaggttagccagattttgcctgcttcttgtggattggccaatttgaataattttccaggtgtcaaggctgaagatagggactgcttctggttgtctgggacctggtaccaggatgactggggagggtgcagagtgccctgaagaatgagaactggataagggaagtggttggaatgtagactcaagaagaatgagccagcctctaaacgaggcctggaagatggatcagacagtgttgaaaaataaaccaaaaaaacccagccaaccaagtaaccaaccagattatcttggaaggattggttctttctggaagctttgagggagtaactatagcatacctcattctttctgggggttgtcagcaaaccttggtcttccttgacatcactccagcctctctctccatcttcacatggccttgtgtattttttgtgtgtatctgaaacctctcctcttcttataaggacaccagtcattggattgagaacctactctaaaaacagaaggatttggtttcaaggccttaactactcgtaataacatctgcagaaacccgttttccaaaaaaaggtaatattctgaagttcagagtagacacgaattctggggggacaattattaatccttttcctgtttagaaaaatcaagtacagctcactgccagtgctcagttaattttacataaacatgctctttgaggctgaagcaaatctgactaattttcaatgtgaaaaagaatataaacactgttcctggtcttcgtctaaacagaactaatatcagaatcatctgaatcatcagaattgtctattttggaaaaattaaattcatcaaatgaatctttggccaacaactgttcaagaatgatgctaacatcacatgtaggtgtaggaatgctacattttctaggatttgacattttcagcgatcgagaagtactgtattttgtaaaaggaaaaccactactaaaaacagcatgctataagtagaatgatgtcatttgtttccaaagttgacatattagaatgacgcaaaaataataataaaagtgaaatagttcgtggcaacattgtctcagggtaactgctgcagctgcaagcaccactggcgagtatcctcggggcaaatgggaaaagggttaaacacactacacttgttctatgaattactaagaggagagtattaaatctctaacaataattgtgggttttcctacttctttcaaatctgctggtttttgcctcctgtattttgagtttctaagttcatatttgatatgtcttcttggagaattgactcttttttgttatgttacggccccactttatccctgataataatctttgttctgccatctggtttgtctaaaatgattatgtctgtctcagatttgttttctttgtgtttccatggtagaaattactttatctttttacttttaacccaactatatatttaaagtatgtttcttgtagacaaataagtatgtttgtttaaaaacctgtatgtgaacatttgtattagcttgattcataatagcttcaaactagtaatcacccaactgtctttcaactgctcaacagataaactgttatcaccatgcaaggaaatactactcagcaatacaaatagaaacaaccaatactctcaataatgcagatatatcttagatttttttgctagctgaaaaatgacagatcaaaaaggctatatacgcaagattccatttatgtaacgtattttaaaagaccctaagtacggacagagaacagatcagtggattccaggtgctcggctagggcttagacaacaagaggcagctggagggaatttgaggaaatgattctgatacagacaggaggccgggaaatactgggtcgaagagggcggtccccggtaagggcctcaagcctagacctgtcgcgcaaagtgacaatattcaccaaagccagcctggcctgccccacccaccatcctgtacccataaaaacccgaggctccactggcagaagagaggcagagaaggagaaaagagaagcagcagccagacgttggtgagaagcagcttgacttcagagggatggcttgactatgggacctcagattagagttcagccgggcatggctgaattccaggagaaaactaccctcccactccaccccttttccagctcccatcccgctgaaagacactttcattggcaataaaatcccccgtggtgttcactgtcttgaattcattcgcgtgacctgattcttcctggactctgaacaagagctcaggatgcagagggctgtcacattgagctgttaaacgcttaagctgtctgtggacagcaaagctaaaagagcacactgtaacacatgccctctggggctccaggggtcccgggtacccctcagaccttgcggcagggctgcacagagctctactccacctggagctcagaagcactcatcctggcccctgcatccgctcacttgagtgctccccttcccgcaagcggttgagagctgcaggctgagtaaatgaaccaccgccatcagacaacagggaaaatttcctgtttcaattccgtaccaagactgtgatggtggaaagatgactttatgtatttgtaactgcatcgaaccatagaccacatgggatgaattttgttgcaagtaaattaagaaatacatttaaaaaatatttaagagggaagaatagctcagccttaatcacataggggcagttagagaactggatatgtgcaacagcgaaaattgtttgattcactttcctaggaattttaacttcagaacctcactggaaatcatctatcgtgctttgtgtgctatttatgctcaaggaaactcatattatattttatctaggtttcataaacttttcatttcctcaatttgttctatattttaaaatggtagaatctagcacatagcagattcttattacatatttactaaggaaataaaagttacctgtagattgattttttggactgactcagtatataccacctgagtatcacgctaaagatggtcttccaggacgggagtggtggctcatgtctgtaatcccagcactttgggaggccgaggtgggaggatcatgaggtcaagagattgagaccatcctggccaacatggtgaaaccccaactctactaaaaatacaaaaattagctggtcgtggtggtgggcacctataatcccagctacatgggaggctgaggtaggagaaccacttgaacctgggaggcggaggttgcagtgagccgagattatgccattgcactccagcctgggcggcaatagcgaaactctgtctcaaaaaaaaaaaaaaaaaaaaaaaaattggtcttcctataagggtcagaatgcaataacagcttgtacaggttttctttaccaggttagtatctgtttaggtgagttacatagttatactcaccggacagacaagttgaaacttattttgatcaatctttccaataaaacaatcattgtgtagtttaaagtcaataactttagaaagtggcttattcttacaaaggcttttttttttttttttaaaggtagtggctcatatagcatggacttcatttctcctctctctttgtattatattaacatgtgtactcttatgtgcaactgttaaatccagtttagtgtaaagctgactccttacatattttaaattcagcctaaaattttctcagtacatagagaactataacctcaatgggattgtaagcagactataacctactcgtgggccaatcatcaagttttagccaatcaaagggaaccaacttttcaaaccatgttaaaataaggcaaacgctgagctctaatcaatcttctgcttctgtacctcacttccattttatgtacatcattttcctttttctgtccataaatcttcttccaccacatggctgcactggagtctctgagcctatcatggctcaggaggctgcccaattcataaattgttctttgctcaattaagctctgttaaatttaatttggctaaagcttctattttaacacaactatttctctgtattgatttatctgtaatcatacatgtcatgaatgaacacataattttatgaaacactttttgtgctgtattatgccatctagattctgatagtttattttcatctgcacaaataaccacatactcttttacacatagcttcaactcatatccttgcctctcatgttcctttatcttgaatgaatttcagttggagaaatgaaagctctgaaatctttactctttcatttaatttgactttttaatatttagaacttaaggatcttttcactttcttttgattcacctttcacaatgagttggcattagttttaggatttgaacaaaccagttgctttttgaaattttttggttaaacactatttgtaatggcaattgttttgattagattcctctactacgcgtgtacggcaccattagaatattacctacatttcgtatcaacaagaagaaaatgacctccatgtcaaccagtaactattttgattacccttccctgccttgaggaattgatgtttatggaactttctggcattcttttatagctaccaaagttttgtctttcatggtgcagtgcctctaaacctaattatacaatcaactatctgttttaaaatgtcttatgtatattaataatggctattttttcccttccaacattttctttccttcttgttttaatatttattaatcttaaaatattgaggctttttcttatatatgttttggccctaatcaatgtccatttaattgacattgagtttcatttatattttctttttctgcttgcttattggattctttctcttttttcctttcattacctttctccaagcttcctgcttcttttcagctttgctttttcctcttcctctaggcttctttttgagatgctagtccccctatgactgtctcccttcttttcatccatgaaccctgactttacaatctgccaatcagccatagccagagtgcttgctctgaaccaggtttggacactattgcttatttcactgaagaatgatcttgctgattttcattagacttttttatacatttcttcccacactttgttttctcattttctcatttttcaccaatttgaactatatcttcctttgtcccacttccatttttttgtatattcttcttatttacactaagttgcttgtttcttttgtgtccagatgcctatagttcatcttctccaagaaagattcgaagcaagttttcctttctatttcgtgttacgtcttccttctcttgtccttttgttctgtcatgcttagactaggcagtgagctggagggaaggaactgactagtttgcataactagaagtattctggatattctataaaaaaataagccaatgaaaagttgtaggttttgactaaaggtgtgaattggagaagaagaatgtggacgatataccaaataaggaaattgtaaattcaaggaaaagaagagacagatgtcgaaaatggtagataagttttattaactagagtgaaggtcatagtagcagtataatgaggagttagtgaaagtctaaaataattgcaattcatgatctggagtgttaatttgacacaagtagcagttgtggatgagtaataggaacacttgcccatatgaaataggttctgcttttctgtacttaacagtgattgtcatgaagcctaatctgaaaaataaaaaaatggaaagaaaaagcaaagtacattgaaaatatcctgtggatgactcattaacactattgatttccttctactagccacaccctaattaatttctccacacagtttcagcacttattctcatggttgaattgtcttatccataacagaggacacaatttggccattttaaaattaaaattgtataataaaatccctaatgcactacttcaccaatgtcattcctaataacttttgtattccattcactgggctatttgggagagtaatccatcttcttataatggtttccattctgcatttttaactgttatacgcatgacaagctctttagtaaaatgcaccattgtccttcatatttaaagattttatttcaaaagctaatattatatttgtatgtaagactgataaaactaacagctttatgttttgagaaatattttaaggaaagtttaaaattataataatatctatctattatttttcattctttgtgtgatataagcagacttaattttaatgtggctaagatggcaacaacatttgcctttaataattattttgtgttatcaatagctttcttatatacattcttaaattctatgaaaattgtttcgattatggacattatttacatcaaatgaagtatcatgtatctagacatggaggtataaatagtgagatcaactaataaggatgaaatctcttatttaaacaaaaaaagaggcagaattttaaaataaaactccacttaaaataccaaaaatctgtgtcacagctctcatcttttgaaacatattacttccaaatcaaaggtgtcctaagctatggtgctttcttctctgctgtcttttcaaaggtcaaagtaaacttaatatttcacttcaatacatacagcatccacactcttcagctgcatgtttaggcttcctctatgttcaacaagaggggtggcatcataggcagaagcttggttgttcctcagcttacaccaacaggacttctaaaattccatactcaggagcgagagccgctgatgtttcaaagtaagaactgaacagctgggaaagaataatgcaccttgcctgaactctgttttaaattccagtctaatatttgggtaatttttgtccttgcaaataatttgctttcttgctaacattcatattgtgttgctggaattaaattgttaatctacaatagttaattagttttactgttaaggaattttagcctttatttttatgatacagttattcccacaaaacaaaaatttctcttgtttattgtaattttatatattccataataagttgcatatatttgtagagaatacaatagatatgctatatataatatgttttacatattgtatataccatatgtaatgatgtattatacattatatatacaataattttatgctatagacaaatatgtgtgtacatttacatataaagagaattactaattgtaagcataaagttattacaaattaatcaagttttcctaacccaatgataaagtactttgagaacaaacaaaaaatcataaatgtatgccttcacaaacatgccacatttcaaataatttttatctaggattatagtttaagggattgataaacttggagtcaaaatatactgctttgtcttccagctcaaatcttgtccagttgtatgaccttgggaatatgacggaactgcacatatctggttattgacttatataataggcctttctaggaaaatcttgtgaaggtcaaacaaagctctgatacgtgtatttcaaaggacatttaaccattgaacgagtgtaaggtgttttaatttttctggtttgcacatcttatattttagactactttccattttctatgtatactctagactctcccataggggttcctttattgaaattagtgtaacctaatacacaaccctatatttgagtttataactaaagtggaaaaaactcctaaaagcccctagactccttctaaagatgtgagatgatggaacacagatgtaactctcactctgaaggtgcagcctgtgggcagtgtcctgttaggcttctcatcttgggtgggcctctggctgggctttgactttttgtacctttcaaacagaaagacatcaaaatcggtgtaactttattttaattaatgaatgcctttggagttttattgcagtttaccttcctcagttctgacttagttgctttactcaagctctcgtttctttttcccaacttctacctttgttctgctctttctcctgttttttcatagtttcattctttcttaatatttattaggtgcatctatgagttaattctcatgtcgatggtaaattttactacaactttcactgtggccagtgtttggcatttaagttattttatttgcttacatccagttaacaatgtggttttcttaagtcctcttttgaatctacatcataaagtcatgcttttcacttcttctcttctccgtttgatcttactggcactttcctaattcacactggcaataattcaagaatgaaaaagttttacccacctttaggctttccctacttcagcatactctctggtttcgtgttaagtttttgtttttgttttttttttttaatagaaagcagatctgattgtttgattcaaatatagataaacccataatacatagagtaaaaaagaaacaataacaaaaaagaagtatctcatcctgtaatcaaagccatctatctcatactgtggtcattttcacatttttctaacccaccagccataggatctgggtttgaatctcacatgtataattcactagatgtataaagttgttaaaaatacttgatctctcaattctgtctctgtaaaatgagaataataacataacctactttacacagttgcataagaactaaattaatcagtattactatatatgaggtgttaagaatgtttagcactgagcaagtattcaattgattatttactactaacaataaagtcaacatcatcattgttattctatcttcctatatgctccagcttaaaaaaaaatagattatctccagaacttcacctgaaacatcctgtactgtgactctgcccatggtattgttactaggtatcattttcattaatgtctgcttaaccctgttctggccattactaaatgagtacttcctttcagaaaaatttctcaatttcttggatcagaaataatctctatcccctatgttctcatttataatgacagtcattcatttgctttgttttgaagttattatgtgtttgtttctctgagtagcatttaaattatttctttggaaaatatgtcagattgatctttttagttcccagtctttagtaaagtgctttgagggaagtaggtgctccaaaaatgcttgccaatttaaatttaaaaatataaataggatataacaattataatcttcaaacaaggttcagactttctaatttactatgtattaatagtataaaatggtactatgtgtgtctgcaacctaaataatcctcctgaaagtaatgagacttttttcctatatacagttacagaatttcaatttgctctatcttccattttagctgattatgaaacaaatttgcatgtcagatgccagtttcatactccaatgactctccctttagattgccttttatattttatgcaactttcattcatgtgaacaccacattaatagaatgtagcactaaagtgtggtaataagtttttgttcaacatccaaactagtgaggaaatgatgaacttatttcataaccagctaaaatgtaaccaaaagtaggtttcctaattgagcaacattagggaaacttattggaaaaagaaacagcattttcacaaagaagtgttagtatgaccacatctatgggcaattccctgtccttacatatttaagtgggctcatacaattaatttttgccaatgaaaaacattaattaacatctttgctatttttgatcacagaaataagctgcaaatatgtatttttgaatttattttgtctaaacagttatgaaatagtaagttagattatgcaagcagcctgaattagagagcatcatgtcatacaggagaataactcagccttcatctattatcatctatcaatcaatcaatctatttaatcacctttcatctattcatatcattatatataactcaaattattaaactatgaaatatgtacatgcagagaaataattttattgtgttaaacactacaatttcagggtttattcatcactgcctcagcccagtctataactaataatacttactaaataaagaacaaaatcatttagttaataggcatttattttcacaaacaaacaacattgcaaataaattcttccctttgttagagtcatttttacttggttggttaataaaatttatttttaaaataatttatcaattttatttgtatttaagtccttttctttatgttggatttcatttcatttagtgaaaccacccttccccatgtgggtcacacagggctaggtctatagtataaaactaaaggaatttctaagagaggaaatacccgatagaatttgctaaacttgtttttggagcatctcctcgggttagggattttattttccaaaataaagttcattttaaaaaatagatcaataacttctaaaacaatagattcttagttaaccctgatgccagctcaaatctttttccaccagcatttcacctgacattgctttgcatctaccaggaggtagaaatcagcaccttacctctttgagttcaatttaccttaaaattgttctgaaataaagagcatagtaagcaatatgtactttactaaaaacttgataagactgaagaagagaatgtttatttcagatgtcaccttgtaaaacttttctttccttatgaatcttcttcatccatgctataatggatgtactaaaattagtacatcctcactttttctcacacagcctttgggtctttaaacttttcttacttttttgctcggtccaaaatgaataaacacatcccttatcttgtgcagagaagctcaacaaatttctctgaaacctggattccaatggtacatgctgagtctgtaccaaatactcaacaaattgcttctcttcctaaatagctgtggtttcttctctcaggaatgttgctgaacaggaggttcacagtctcctttcacttagatggcctgaacttagactagtttatcgtaccctttcatgtccctaaaatgtcagtgtaactgttgcctcctcttttgagatttctttgaacccttatatcgtcctcagtcatattaagtttcagtgtgcatcccgctaggtagtacttatcccacagagtagcaaaaattattccactccattggaaactgtaggacactgagtcatgtcaaggagtttttcatcctaccagatcatagaaaatgaaagacagaaaaacaaaaacctaaaaagcagctatagtcaaataagatgaaaatcaagcattgagtattgaatttagcaacatggaaggcattcgtgatctgaaaatcagtagtttgggtggtgatgcgggggtaaaattctcaatgaatttgattttataaagaatgagagacgagaagagaaatgtctatcatcattaaaaccttttaggagtttccttgcaaattgaaattaaaaatgagtcatttcatgacaggaatagtggcattcactaagggctattttttttttattttaaaagacaggatctcactctgttgcccaggctggagtgcagtggcatgatcatagtgcactgtagactctacctccttggctcaaatgatcctcccacctcagtctcctgagcaacttggactacaggcatgtgctaccatgcctgagtaattttttagaacatgttttgtagtgattgggttctccatatgtggcccaggctggtctcaaactcctggcctcaagtgatcctcggcctcccaaagtgatgaaattataggcataagccaccatgtctagccctaaggctattttaatatttcatatagtaaaaacaaaatggatgacaaagaagaaagagtggaaatttgctggaggaatgtccttgagtagacagtagtgcaagagcagaattggcttgagttaaaagcatgcacagcttattcattcaagataacaggacagatgggcatgtggttttagagaatggaaatctgaactagactagacagttctagttctctctctttttttttcttattgtgtttagtgaaacaaaaacaaccgaaaatgtgggcgtaagacatctaggggagtaagacactgtaatttctgggtaacatcacaaattcacttgagtatgccaatcgagtgggtagtgaaattagtcagtgtggttgttttcctcctgccacactcagatgtaagagtgcaggcatgacatagctgaagagctgatttaactaaagctgtggccctctcaagaaagtacagcaaagcgagagaagacatcattggcctgaagaaagtgagaggtggtagtaataatgcactgtaagcccagtatattcaaaagatgtttgagttgagatacttcagtgatgtaaatacttagatggattttgggaagtgagtagcgtgcacataaattggtgttatagagagacttatgcaaatgccattattagctatttgtaatctctttatatagggcaagcattgttaaacattttgatttagtggtattcattctgtttcagtaattttcttcacagcatttcaatcctcctcctccccaaaaaagacaaaacaaattctaaaaatctctaagagttccctttagtaagtagttatgtcccaataagaaatatttatgctctaataacttagttgccttttgaaaaaataaaacatatacattaataatacacatacattgtttcattcttgactaatcacagttggtgactaatgcagtgtgggtgcctgtagggcactgcagagctccttaggttttggaatcatatttgacactgatatctcattgcctatcccacattaatttcaaacagcactcaatttatgtcacagaaatcactgaagacccagctttgcagagataagacatgaccaacaggaacgcagtgtgagctaatgttgagacagtaaactatctggagcgagtagtcagctctgtgtctgacagattggagtttgctgagattctgcagggtgtgtgagtgtagggattataggtataagatatgaccatgtgaataaatggctatggtgaaatggaggtcaagctcactggaaagagaagagagcaagaaactgtgcagccagggtgtgcggaagattacttaaatgtattttaaaatcactaagataaggcagaaatagagtctaagagtataacattgcgctagaaaataaaaccacaagaaataaggaaagtaacttaattacaacgacaactaagtgtagtgggggatgtagtatgatgacacaggaatagaagtggggaaattttagagaaaagcacagggagaaaggacaaatagtggaaatggggaacaaataaaatttatatttctcattccaagcccaaatgtatgaagtttataggaaaacaaacgaaaatgagccatcacttgagtgggctgtaggaaaagtggtgtcttcagaggaaggccaatttcccaatagagcaaaatgttgagagcagtattcacagaagacattgagatttggaagactttgcattctaagagaacgttgagagggcttaagcacttttgaaagaggagaggaaggggacagacaggaatgtgcagagctgataaggattagaatctgggaggtatggctgacttgattctagaaatgtgtattgtaactgacatgaacaggaattaatgttcttggtagattcaaggcagacagttattgtacagctgtaggtgaaaggagagatagaagggtgagtatctgtgtctctcttgactctcgtgtataaaaacaagtaggttcttatttcagttatactgattgccctgatgatgagggtaaatggctcagtggagacaaacatttacaaccagaatgagagttgattcatcttctctgttgaaagacaggttagcttccactgagttcatgggcttccttcttgatgactgttgataggattgagcacatctgggaaatcagtatgttattctaatattgatatctcttttttttttacccttaataaagacaaagcaaagattaagtgaaatgtggtcttattcacctgcctagatccgcttctggtcatctctgatttgggtaaactcctaagagatgtggtcttagcttggggatggtttactcttgtttccatttgtggagtcatgaattaactgttagtgtgctgactctctctggtctccatggatggaggataaatgaattggataattaacaaataattactactataatatttagaattaaaataaatagaattatttatttagaataattatttagatttaaaataaatagaagataaaatctattcatttttccaagatggctgaataggaacagctccagtctacagctcccagcatgagtgacacagaagatggatgatttcagcatttccaactgaagtaccaggttcatctcactggggcttgtcagacagtgggtgcagaacagtgggtacagcgcactgagtgtgagccgaagcagagtgaggcattgcctcacccgggaagtgcaaagggtcagggaatttcctttcctagacaagcaaagctgtgacagacagcacctggaaaatcgggtcactcccacactaatactgcgcttttacaatggtcttagcaaacagcacacgaggagattatatcccacgccagccacgcctggctcagagggtcccatgcccacagagcctcactcattgctagcacagcagtcagatagaactgcaaggccgcggcaaggctgggggaggggtgcccgccattgctgaggcttgagtaggtaaacaaagtggcccggaagctcaaactgggtggaacccaccacagctcaaggaggcctgcctgcctctgtagactccacctctgggagcagggcatagccaaacaaaaggcatcagaagcctctgcagacttaaatgtccctgtctgacagctttgaagacagtagtgtttctcccagcaaggagttggagatctgagaacggacagactgcctcctcaagtgggtccctgacccccgagtagcctaactgggagacaccccccagtaggggcagactgacacctcacacggacgggtagccctctgagatgaaacttacagaggaatgatcaggcagcaacattgctgttcagcaatattcgctgttctgcaacctctgctgctgatacccaggcaaacagggtctggagtggacttccggcaaactccaacagacctgcagctgtgggtcctgactgttagaaggaaaactaacaaacagaaaggacatccacataaaaaccccatctgtacatcaccaccatcaaagaccaaaggtagataaaaccgcaaagatggggagaaaccagagaagaaaaactgaaaattctaaaaatcagagtgcctctccccctccaaaggaatgcagctcctcaccaacaacagaacaaagctggatggagaatgactttgatgagttgaaagaagaaggcttcagatgaccaaacttctccaagctaaaggaggaagttcaacctatcgcaagaagttaaaaaccttgaaaaaagattagacaaatggctaaatagcataaccaacgtagagaagtccttaaatgaccccaatggagctgaaaaccatagcacaacaactacatgacgaatgcacaagcttccgtagctaatttgatcaactggaagaaagggtatcagtgattgaagagcaaatgaatgaaatgaagagagaagagaagtttagagaaaaatgaataaaaagaaatgaacaaagcctccaagaaatatgggactatgtgaaaagaccaaatctacatctgattggtgtacctgatagagggggagaatggaaccaagttggaaaacactctgcaggatattatccaggagaacttccccaacctagcaaggcaggccaacattcaaattcaggaaatacagagaacaccacagatatactcctcaagaagagcaactccaagacacataattgtcagaatcaccaaagtcgaaatgaaggaaaaaatgttaagggcagccagagagaaatgttgggttacccacaaagggaagcccatcagactaacagcagatctctccgcagaaactctacaagccagaagagagtgggggccaatattcaacattcttaaagaaaagaattttcaacccagaatttcatatccagccaaactaagcttcataagtgaaggagaaataaaatactttacagacaagcaaatgctgagagattttgtcaccaccagacttgccctacaagagcccctgcaggaagcactgaacatggaaaggaacaacaagtaccagccactgcaaaaacatgccaaattgtaaagaccatcaatgctaggaagaaactgcatcatctaacgagcaaaataaccagctaacatcataaagacagtatcaaattcacacataacaatattaaccttaaatgtaaatgggctaaatgctccaattaaaagacacaggctggcaaattggataaagagtcaagacccatcagtgtgctgtattcaggaaacccatctcacttgcagagacacacataggctcaaaataaagggatggaggaagatctaccaagcaaacggaaaacaaaaaaaagcaggggttgcaatcctagtctcagataaaacagactttaaaccaacaaagatcaaaagagacaaagaaggccattacataatggtaaagggatcaattcaaaagaagagatgactatcctaaatatgcatgcacccaatacaggagcacctagattcataaagcaagtccttagagacctataaagagacttagactcccacacaataataatgggaaactttaacaccccactgtcaacattagacagatcaacgagacagaaagttaacaacgatatccaggaattgaacttagctctgcaccaagcggacctaatagacatctacagaactctccatcccaaatcaatagaatatacattcttctcagcaccacactgcatctattccaaaattgaccacatagttggaagtaaagcactcctcagcaaatgtagaagaacagaaattataacaaactgtctctcagaccacagtgcaatcaaactagaactcaggattaagaaactcactcaaaacctgaacaacctgctcctgaatgactactgggtacataacgaaatgaaggcagaaataaagatgttctttgaaaccaatgagaacaaagacacaacatatcagaatctctgggacacattcaaagccgtgtgtagagggaaatttatagcactaaatgcccacaacagaaagaaggaaagatctaaaattcacagcctaacatcacaattaaaagaactagggaagcgagagcatacacattcaaaagctagcagaaggcaagaaataactaagatcagagcagaaatgaaggagatagagacacaaaaaacccttcaaaaaatcaatgaatccaggagctggttttttgaaaagatcaacaaagttgatagaccgctagcaagactaataaagaagaaaagagagaagaatcaaatagatgcaataaaaaatgataaaagggatgtcagcactgatcccgcagtaatacaaactaccatcagagaatactataaacatctctatgcaaataaactagaaaatctagaagaaatggataaattcctggacacatacaccctcccaagactaaacaaggaagaagtagaatctctgaatagaccaataacaggctctgaaattgaggcaataattaatagcttaccaatcaaaaaaagtccaggaccagacggattcacagctgatttctaccagaggtacaagcaagagctggtaccattccttctaaaactattccaatccatagaaaaagagggaatcctccctggctcagtttatgaggccagcatcatcctgataccaaagcctggcagagacacaaccaaaaaagagaattttagaccaatatccctgaccaacattgatgcaaaaatcctcaataaaatactggcaaaccgaatccagcagcacatcaaaaagctaatcccccacgatcaagtgggcttcatccctaggatgcaaagctggttcaacatatgaaaatcaataaatgtaatccagcatataaacagaaccaaagacaaaaaccacatgattttctcaatacaagcagaagaggcctttgaaaaaattcaacagcacttcatgctaaaaactcaataaattaggtattgatgagacatatctcaaaataatatgagctatttatgacaaacccacagctaatatcatactgaatggacaaaaactggcagcattccctttgaaaactggcagaagacagggatatcctttttcaccactcctattcaacgtagtgttggaagttctggccagggcaatcaggcaggagaaagaaataaagggtatcaattaggaaaagaggaagtcaaattgtccctgtttgcagatgacatgattatatatctagaaaaccccatcatctcagcccaaaatctccttaagctgataagcaacttcagcaaagtctcaggttacaaaatcaatgtgcaaaaatcacaagcattcttatacatcaataacagacaaaaagagagccaaatcatgagtgaactcccattcacaattgcttcaaagagaataaaatacctaggaatccaacttacaaggcatgtgaaggagcacttcaaggagaactacaagccactggtcaacaaaataaaagaggatacaaacaaatggaagaacatgccatgctcatgggtaggaagaatcaatatcgtgaaaatgaccatactgcccaaggtaatttatagattcaatgccatccccatcaagctaccaatgactttcatcacagaagtggaaaaaactactttaaagttcatatggaacgaaaaaaagagcccacattgccaagtcaatcctaagccaaaagaacaaagctggaggcatcatgctacctgatttcaaactctactacatggctacagtaaccaaaacagcatggtactggtaccaaaacagagatatagacgaatggaacagaacagagccctcagaaataataccacacatctacaactatctgatctttgacatacctgacaaaaaccagaaatggggaaaggattccctatttaacaatcgtgctgggaaaactgggtagccatatgtagaaagctgaaactggatcccttccttacaccttatacaaaaattaactcaacatggattaaagacttaaatgttagacctaaaaccataaaaatcttagaagaaaacctagattataccattcaggacataggcatgggcaaggacttcatgtctaaaacaccaaaagcaatggcaacaaaagccaaaattgacaaacgtatctaattaaactaaagagcttctgcacagcaaaagatactaccatcagagtgaacaggcaacctacggaatgggagaaaatgtttgcaatctgctcatctgacaaagggctaatatccagaatctatgaagaactcaaacaaatttacaagaaaaaaacaaacaaccccatcaaaaagtgggtgaaggatatgaacagacacttctcaaaagaagacatttgtgcagccaacagacacatgaaaaaatgctcaccatcactggccatcagagaaatgaaaatcaaaaccacaatgagataccatctcagaccagttagaatggtgatcattaaaaagtcaggaaacaacaggtgctggagaggatgtggagaaataggaacagttttgcactgttggtgggactgtaaactagttcaaccattgtggaagacagtgtgccgattcctcaggtatctagaactagaaataccatttgacccagccattactgggtttatacccaagggattataagtgatgctgctataaagatacatgcacacgtatgtttattgtggcaatattcacaacagcaaaaacttggaaccaacccaaatgtccatcaatgatagactggattaagaaaatgtgggccgggcgcggtggctcacgcctgtagtcccagcactttgggaggccgaggcgggtggatcatgaggtcaggagatcgagaccatcctggctaacaaggtgaaaccccgtctctactaaaaatacaaaaaattagtggggcgtggtggcgggcgcctgtagtcccagctactggggaggctgaggcaggagaatggcgtgaacctgggaagcggagcttgcagtgagccgagattgcgccactgcagtccgcagtccggcctgggcgacagagcgagactccgtctcaaaaaaaaaaaaaaaaaaaaaagaaaatgtggcacatatacaccatggaatactatgcagccataaaaaataatgagttcatgtcctttgtagggacatggatgaagctggaaaccatcattctcagcaaactatcgcaaggacaaaaaaccaaacactgcatgttctcactcctaggtgggaattgaacaatgagtacacttggacacaggaaggggaacatcacacactggggcctgttttggggtggggggaggtgggagggacgcattaggagatatacctaatgctaaatgacgagttaattggtgcagcacaccaacatggcacatgtatacatatgtaactaacctgcacgttgtgtacatgtaccctagaacttaaagtataacaaaaaatatatatatattataaaatctattcatttttctgtttttctggtcgacagagcaaatacaatcttttttcaaaaaaagtcttgaaattcatactcaggataagaaaaaattatattctctgcacatttttcaaaaactgccactaaaagaaattttatacctattgtttttattccaaaatgtgtactgcagaaatgaaatatgtcaggagtattactgttaatgctgggcaaataaaataagagtggcagtgatattcataacagacatatagaagtgttgtgaaaaattttactgccagctgagatgagcaaaatataagcataaggtgtaactcactattccttattgagaagatgagagatatgggtttaagggattccagctcagtttaattcaaaagttcaggatcactttgcattaaattcaggatcctgctatgaaaggtatactggggcttccttaactatcactattttaactttatttttaccttttccaaactttcgtttttctcactttctgttgctttcttgttcttctaatttctatcaatattctttgcatgtgcatcattttatttgtatcttattcattactcatatagaactttttaaatatctcattatcattgttttttttttttttttttttttttttttttttttttttttagagagagagagagattcttcctctgtctcccaggctggttcactgcaacctcctcctcctgggttcaagagattctcctgcctcagcctctcgagtagctgggattataggcagtcgccaccacgcccagctatttttgtattttttagtacagacagggtttcgccatgtttcccaggctgttttcgaactcctgacctcaggttatccacctgccctggcctcccaaagtgctgggattacaggtgtgagccaccacacccggcctatcatttttatcaattatatttccaatgtaaagttggtaaatacatgataatggtgtgtatttaacttatgcttgcccagctctgatcttttggttggttaggaactaaattgatctttaaagattatgacctacagacttgtgaacttccataaaactgggaattaagacaaataggtctgtctaataatataactaaaataaaaatacttgagaaatagtataaaagtacttccacttttttctcataattcactgagattattttctcatcatatttttcatacattaagagaaacaataaagaatgatagcccagaaagatgatatgtaactagaatataataaacagaaacctaagaaagttaaattttaagtaaactttcattctaagtttaatatatttagtaaccataaaaagcaagtaacagcaaatgtaataatatatattgtttgcacatctatgtgtatatacatatacacatataatacactagatataatggcaatgtaaataccttcaaaaaatatcatcttgtctagtcaaataatttcagaattatttatgaagccattaatcacaacaatttgtatgaagccattaaacacaacaattatctaaaatacttatattttagttggttctaatattgataaagttttaacagctttaaatggaagctttgtcaaaatgaaaaataatattttagtgttccaaaattaagcacttacaaatagactcagacaggatactggacatccattgataaaataagatgtacgtgttatacactatcatataataaactagagttgtactctacactgctttcatgtggaatccctgggtttataattccatatctgtatatttgttcagaattgtaatgtttactatatacattatgtgccctcgacaatgtcttcgaaaaatgaataaagaaggaaagattaacagtaacacagaatgaaaccaatccaagcagcgactactgttactgcagtaacagaaacaggttctgtgttgcttagcactgtgtcagttttgtaatccattgggatgtgatttatgaaagagtctcacagatgaggcaaatatacagattatattgcagtatcataattaagcagtttttcaaagagcaaacacttcatatgcataacaatcttaccttatctgctcttgcaggtttgtcgttttttgtatttatgattatgctttcaaaaatacatgcaaatttattgttgaaattacagtatttggctattctttctaatacctatcacagcaattattgtatgtgacacctggaagcaaaatgtcattcacactattctatctaattggaatatcatccattattgattttgtattccatttagatgtagctatagttgacttgaaatctaggagatataatggaatttattactatcaaaagagtacaacaacttagaaaaaaatctcagacaaataaaaagaacagagtctgctgcctccccagtgatgatcgctgtgattgtgttacagcatgaactggataataagaattaatccatgacaatgtttgctccaaaaaacagatgaagactcacctactagtgattctcttccaatttgggtattcaaactaatacatgttaaaatatctagaaaatatgatcatgaattacttgtataagctcactactatctttgcataaataacacaaaatatgtaattgttagtggtatatttttatgctaagtaacttcaatataattcaagcccaaagcggattgattagacagacctaagctaacaaaaatatgataatttgaaaataaattttactgtgaaacttacattttatactcagattaaatgttatctttaaagtggaaaatgttctaaaactgattttccttagttaatcacttaagattctttagttttgcttttatttttgacccacaaaatgatatttaagtgagaaagaaaactactcatttaaaaaattgtcttccgactgttacaaccattgcaaaagaaataatgtttacaatttcaaatatgtctatacttttaaaatctgtattcatatttatacatctggaaaaataagctaccttcacagaaaacattaattatatgatatttttggtattttctacaggattgagactctatgaagactctcctacagtttttgccaactcagagaattaaaagtggttcagccatcacacagcacttggagaaaatttccatttcattaaaaggaaacttccacgatgaaataaaaattttcaatggtgttcatattgagaaatactgccacactaatgtcaaatacgttaatgttttcaagtagtcacaatgcagttataattagcaagaatgaatacattcagctctggagtcgggcaaacccagaatggcattcaacctctgccacaaccctactgtcattttgagcaaataatttaactctgagctcagcttcatttcatgtaaaatagacacagaatggctttcagtcacaataactgtttggaaagataaaagcaataatacctatgaagtacttagaataatgtctgatataaagtaagaggtcaatatctttatgtgtattgcagttgtcataatcatcttaattgtagtcatcatcatctccattctcatcatcacactgctgggtaagtctccagccgttggctcacaacttgcactaatgcaatgagatattgctaaaactgtataatgacatactgaaaaactctaccaatactctctaatttacagattgcttcagtgagttgtgtacatgtagttataagaaacggataatgcagccacaatggtctaccaacataaagcctcatttttatcattcaggttgacttctaatgaatcccaggctgttgtcactactctgggtccctttgtctgcttgttttctcctttagtgtgtagttgttttcctcatgattgcaatgtggctgtagcccttcccagcctcaatctgtgtcacagatagaaagaatagggaagaccaaaggtacagagacacaaagaggaaaatcctgtaagccaacccatcctgtctctgtcatcagcttggctgagagcatcgccagggatttctgcttacaacttaacagagcaaggtcatgtgaccaatccagctataatgaagtcttagaagctgacaatagagctttcagcctctgcaaaggaatgccttttgacaggtaatctaatgtctgtagccacagaagagagcaagagaataagagtagtgccatataaaatagaaatctttcagtccatgggtcttaatatctgtacagaattatttcagcttctaaaagtatttttctgaactgaaagtgaaccacctactttgaatgggcaggtagtaagaacagactgaggcagggatagagatttttgctttcagaaaaaaatgtgaaacaacaaaatatttaacattaatcggagttctacatgctgcagcttgaaaatgtaagtagtcaaataagtaagctagttatctggagacagggctttgctatggcctaacttttgctgaaatggttcatttaccccaatgtagagatgaaacgaaggcctctttccaacatccctagttaaacagaacatctagaattttctgaagttctaggagttctggagtcagccctaccaagcataccatactttagaggggaaaaaagagataaagataatagtatttgagactggtgatggatcagacatttctatgaacacaaatgaaatggtccatgtaaaaattcccacaactggaatagtaagtaaaactacatgcaactcctagatagcatattcatccattagagtgatgatattgtaggtttggttaacaggaagcagttaagaagacttacaaaaatacatcctactcctcaggggaatctgacctcattcccctcacaagtttgggagagagaattttgatgatttaatttccattactagtagtactaatttccattactagttccattttgaacacttaaaaattgataatgaggtattaaaggaaggcagataagactggggtaaaacaagagtaggtgtgagtgaatttctaggaaaagtttgctcaatgtaaagaaagacctacatgaatatataatctgtgatctctgtttcctctggacacatttgtttctggatatgatatataataaagctgcgtaccccttgttaccaagaaggaaactaggttgacgtaaaatcctgtctaccaaatgtggttaagagaaaagaaagtaaatttttatgatgccattaagccccaaatctggtcaatcatgagggttcactgtcactgaatttcccttcatataggacacacttctttactatttaagctacctaaggtttcatttgtttgtttttgttatttgcctccaaagatacataaactaatgcaacatgtttgtgaaatataaaggaatatgatgaacaataaagacgaaacaggtattaagtcagaatttaggattattttacaggttaaatttttaataactaagttccttttctaaaatattaatgagggaaggtataaaccacggttgtctagaacactagttatttattttatagttaattttttgagataattatagactcacatgaaattataacatataaaacggaaatcctatatgcccttaacccagcttctcctaatggttaacatccagcaaaactacagtattatactcacaaccatgatattcatattgatacagtacattattattaagatttcctcagttttacctgtactcatttgtgttgtgtgtgtatggatttcaattttatctcatgtgtaggttcacatagccactaccacagtcaagatacagaacagtttcatcacgacaagactctcctgttgcctttttaatatccacctgtcttccctccaccacaccctaattgctggcaactattaattaattttggcttttcaaaatgtcctgtacatgaaatcaacctgtatgtaacctttggagattgtttctttctttcagatttacccaagttgtgggatgtgtcgctgtgtttctgtttgttttaattgctgtgtagttattctctaagatggatgtaccatctataagatggtttgtttatcacttatcctctacctattaaatgacatctggattgtttccagggtagactgttatgattaaagctacgatgtgtatttttgtttagggtttagtataatttttatttctatgagacaaatggcaatagtactcctttattattcttttaatggccacaagatatgaatgaaattcccctttttcattcttgatattgatgatttgtgtctcctctatttttatgtttgtctagactcctagaggtttgtcaattttattgactttttaaaaataacaaggtatttgttttattttctttattgttatttttaaaatttcattgattcctgctgtagtgtttactttttttccttctgcatggattttgttttttgcatttttttctttaggattttaagggagagcataaattactaatttgaaccttttcctcatttctattgtaagcatttaatgctatgaacccaatactgccataaatacattacacatgttttaaaatgtggtcgttttaatttaattcatatacatacacacacatataatttgcttttatgccttctcttagacccatgggttattcacaagtgtattattttgatttcctcatattcatatattttactgtagtctttctgttacttcacggtcagagaatattatctgtgtgattccagtttttaaaaattttctgaagtttcttttatgtcccaggctgcagtctatactgatgaatagtccatggatagttgtaaaaacaaaaccttcattcttctgttgagaggaacgctctatatatgtcaattagatcctgttggttgattgtgttgttcatatattctaaatatttgcagatttttctgcctagtagttttatcggttgctgagaggagactgttgaagtctcaaactataattgagaatttttctatttctcctttcaggtctatcagtgtttgtttcatatattggagttttgctgttacatatgtacatatctcaatatttatgtcttcctgatgggttcatccttgaatctttatgtaatgttcccctttttctccagtaattttttcttttactatcttctacttaattaaagatgtaacaactcctgcgtttttaactaatatttgcattcacattttaagtttaaatctttcaacctgtatttcattgaactggaatttgatgtgtttcttttttttttttttttttttgaaacggagtctcgctgtcgcccaggctggagtgtagtggcgctatctctgctcactgcaggctccgccccctggggttcacgccattctcctattctcctgcctcagcctcccgagtagctgggactacaggcgcccgccacctcgcccggctaattttttgtatttttagtagagacggggtttcactgtgttagccaggatggtcttgatctcctgaccttgtgatccgcccgcctcggcctcccaaagtgctgggattacaggcgtgagccaccgtgctcggctgatgtgtttcttataaatggcacgtagctgggttaggttttttaatttccttttttttttttttttttagacggattctggctctgtcgcccaggctggagtgcagtggcacaatctcggctcactgcaacctctgcttctcgggttcacgccattctcctgcctcagcctcccaagtagctgggactacaggagcccgccaccatgcccggctaatttttgtatttttagtagagatgaagtttcaccatgctaactgggctggtcttgaactcctgacctcaggtgatctgcctgcttcagcctcccaaaatgctgggattacaggcgtgagccaccgtgcctggcccagtccctgtcttttgattggtacatttagagttctgatatttaaggtaattattgtgatgttagagctctgccattttagttactcttttgttttctctcgttgtgctttgttatttttattttcttcctgtgggtattattttgagtttcatatagatttacttatcatgtttttgaatgtgtcttttcgtaatttttaaaataaaaatttgaaagttccaaaccacctttctgagatcatgcttactaatataggaaaatataattcagcaacctcaagaaatcaagaatccaattttcaaaatgttactcactctatcttgaggtcataggttgttcctgagcctaaccctcactattcaaagataatgtacacaggtgactgtgggcacatatagtttcacaactcctgcaaattcttctctagactactcactaaacttagtaaaagggcaagatattacccttttagatatgtaatggtaacaatttgtcatttttcttccattggtcaattttaattcgcattaatgaaacaatatgatgtacctgttgcttctgtcaatagggcataatatttattaaaaatcaagagagcttttgtagctacctatacatgtaaagattgcttattttttcacactgcattaatcttatgactgatagtagattgatgcccacctcataccctatgtgaaaatacataattgtccccaatattaattcttcccttcttccttagcacatagtagaatttccaaatgcttgctgagcaaaaagtaaagcctacatttttaggatcccttgaatctagttctgacaatgtgactaaattctggccaatgggatgcaaacagaagcagcatatgtacctttcagaaaggtattcttaaagaaaacaccgtattcttctactgcacttctgtctttccaactggctaggttgctggttggagtcagagttggcgtggccattttggataatgtctaatccacttgatgcaaagtgtagacagaaacataaagggttcctggatctgagaattgaggttctgaaattatgctgcttatatatatatatatatatatatagtgcttatgtaagagagaaataaattatattatttcaacttaaatttgttgtgcattttatatcactagtagctgaacatactaataatacagttctcaatgctaattccattgtgaatgccattttcacattggaacttattcagataaatcatctacagtaattgttactgcagcaacaacttaatctttttttcgtttgtttgtttttttttttttttttttttttttgagacggagtctcgctctgtcgcccaggctggagtgcagtggcgccatcttgcaatttcggctcacggcaagctccgcctcctggcttcaagcgcttctcctgcctcagactcccgagtagctgggactacaggcgctcgccactactcccggctaattttgtttttgtattttcagtagagacggggtttcacgtgttagccaggatggtcttgatctcctgacctcgtgatccacccgcctcggcctcccaaagtgctgggattacaggcgtgagccaccaagctcggacaatttaatctttgaaaattgatattatcatgttactttcttgtttaacacacttgactagcttgcaaaattctattactgttgaagccaaatccttcatacgaccagcttcctcatctctacaagtttagtacatttttttcttcctcttatatttcaaacaggacagccttatttttttatgaattatgttatattacatcttacacatatcctttggtcataattttgttcctcccaaatttcaaaatcttgttttaatatatatcttattaagtttttatccttcgttctcagagaaagtatttcttcctttgaaaaatctcctggactccttgatttatgtcagatcctttcacttgacaccttcattaaaatatgtgtctttacctctgtactacaaaatttttcaattcatgtttgtggcccctgttagactattaattccatgagtgcattaagttacatgtttctttttgatttttctgtaatgctggcatctggcagtaaagcacagcacttagcacatagcaaatgctcagtaaaggcttttaaataagtggatttttaaaaattatcaacacttctctttgaaaatggtgactttagcacttgactcactgactttctctatacaacatgtcacgaaacttaagatctctgtggcaacttattctctctgctcctcaaactattatccaaaattttttcccattctacttcagtcatataatatctttatatcatggacattgataccaccaaaatgtcagccactaaacactctttaaacataaccttctggctgggcccggtggctcatgcctggaattccagcacttcgggaggccgaggtgggcaaatcacgaggtcagtagatcgagacaatcctggccaacatggtgaaacatcatctctactaaaatacaaaaaattagctgggcatggtggtacgcacatgtaatcccagctacttgggaggctgaggcaggagaatcacttgaacctgggaggcggaggttgcagtgagccaagaacatgccactgcactccagcctgggcgacagagcaagactccgtcaaaaaaaaaaaaaaacaactgcttatatttcttcttcaattatttctactgccctgtacttgacatcaatggtactacaatctgatgactatgttttgactctctactactccaacattacactaaagattatttctaaaatacctcagaatgtatctcaggaaaaaattaatctaactgcctgtgccctctgtgagtgctgccagccgtctgattggaaatggggacaccactcctcacacggggccttgacattgcccagacattgtccattcctaaggaaattattttttgattctctgcctagtaaagattcaccccaaatccacataaatgatttagaatgttttccactgaaatgctagaattatatgtgagttagagataataagcaagtaggaaataggaacaattcaaggttggttagttcagttgctcagcaacgtcttcaaggaactgggccctttctatgctgccatccccacctcttggtattaccttccctcatggtcatgagatggccatagcagtactaacgctgtgtgaacacaggacgatatccagagaagagaggtgttttcctccagcaactgtctgcattatcaaagaaaacctttcccagaagctgaccaagaggctctctctcgggttccagagggcataattaggcaccatgtgcatcctcttactaatcactagcaaggagactgcgaccaaaggaatctgtcacatcagcactccccaacatttttggcaccggggaccaattttgtggaagacaatttttccagggatggtgggtggcgggatgatttgtggttgaaactgttcaggcagcctagatcccctgaatgcgcagttcatgatagggtttgtgctcctgtgagaatctgctgctgcttatgatctgacggcaggccacgcacaggcagtaatgcttgcccatcactcacctcctgctgtgtggccgggttcctaacaggccacagactggtaccagcctgtgacccgggggtcgaggacctctgtgttagatacaagattatttattttggcataaagtggttaaaacctttctgtaaataaatatagtggtgaatatctccacaaaattaaatctttgttagcaacaaatgaaaagacatggcttttgatagtcaaccaatagcaggaaagtagtgttacagaagtcaaggaagcaacagtttgaagagagataacttaattacagtgattctgattcagtgagatatagaaataaaaaacacactagtaatttgaaggtcatttctaactcttgccaaataatttttgtctagtgacaggagtacacagacttggaaggaaatacttacaatatctcaaaaacgacccaccttgtcaatggtatttcctaaggttgaccctccttaactctaagatcctctgctttaagtcttagaagaaggaaaataaatagaaaatggaaattgggatgtacaaggagttaaaatgacagtgattaaaatgataggtagattaaaggtgggctgtttcattcactattctagttggagttcaggaaaataatataaaattaatcctttgaaggtaaaccttagaaataatcattgtttctgctttggatgggaatgcaacttatatggcatcctgtggaatttattgatgcctctcatttatcctaaaagacagattcttcttttacaagacaacagatgaattcccttgaggttattcctcactttctgtgtggtgatatacagagaataggtgaagagctgatgactgggtaggagttatttctaggaaaggtctagtgttgatcactgtattagaaaaagagtaatttaagaaatgttgtaaatattcgtaatatcacattagcacatacaataattgtcagctccataaccaggcatgctgttatctctctttctaggatagctaatacatcctaaaatgctctgatacgctgcggggttactaacactgtctttaatgcagcatttttctttgaaggactgaaaccaagtggtctctccagggcatcataaatcttagttttcatttagaatatagaaaccataaagaaaataaaacaatatttaagcctcagagaaggccaatttccaatacgaaatgggattgttatgagagtaaaggaatgagcagaggagaataggaacactgcaatgtacacgaggctgccagaaacaaaataaaggaggcacgggagccctggggactctacatgatagagcagtgaccagaaaactgaaatggtccacatggactattcattttttcagccatctgtactaaagactgtagaatatcaagatttcaatgatattgctaaagacagatgctcatatgattttaaattatacatttgaaactttgtgtgaattaagaagtcatcatttgaggtaaatatgcaatagaaataatatgatttgacaaagctttgaggtaaaatgatttcatggaattaagtcacaatacattataattttctaattatatacaacatctttaaacttttgaagccattaaagcatagcaggaatttaatgagagatctaattttgtgtacatctatcgcatgattcatttcttaaaagttcttgtgagtcaaaatgtgggcagggaactttcagactgtttatctcccaataatatgttattgttctatttttatatattccttgggatttgcaaaaataacaaaggtaaattttcttacaaaaatcgaagagcatcttcattaattaaaaggaggaaacttttctgtaaatctttattagaagagttggctagcccaaatatatcagcatattttattgtgtgttatttatagttaaaataaaaataatattaagtaataattgacttaatcaccaaaataacaggtaatcagaattaacatttaacaagcacatgtgataagtgagacgctcttctaaatgttttagatgttatcacccattttatcttcatgataactgtatgaagtgctgacaatgttttcaaggaattttgtaaatctgttaactagaacacagtttatatcactgagtacattaaggagctggagcttgacactaagtagtctgacttcaaaatctgcttgtaaatttttttcactcacggaacagcaagttgttaatatttttatctaaaataattttgcagataatgctgtcatagtgtattgaaatgttgtaaaagtattaatatgatacaatttaaggattttccaggaaaacataatctctttcattcttcttattgtgtttgttcccaatccattaataaatgactaaatccctttgcttaaaatcatacagtaaaataaaaatgctcatggataggaaaatatttcatgttgcaattaaccacctcttctcttgtatagagtttctgagatgtgggcaaaaaagagccctggtatcaaaattaccaaatgtacaaattatttaaacatttctaaacatattccatttcttctagtggagatcaaaactggttactaaagaagttttcaggtaatttgtgtgtacagtaaagagttaaacattgactctcataataattaattatatattcctaaaagtaagatgtgagtgagcttaaatatattggatagcttaaactgttgagctgtaataccactaaagatggaagactgaaaatacaaagaaacggtcgtagattcttgtaaacattaaaatgctaccgagagaggccactgactgaggatgatttcaaatcattatttatttgtcagaagtaaatgtttataaaatatcacaaaagattaccaactatttaacgtattgaaaaatgttgactatttgtttttagattatcctttacaaaaaaataaactatattaaaatatttggaaattaatattaattgactgtgacaaaccaaatgtcactaaaacatattgtaatatgacatttttgttgctttttcagaatgatggtatctgttgctttaaatatctacataattgactaccattttaaggtctttgaaatatacaatttcctattataaattatttttgaaaagggaattgctttgcattttgagaattttcaaaagcaaaaccaagacctatgcatatgtcaattgcctaacattaaaatattaaaataaaaaattacaaaatacttttgtttacaaaagtatacaactgtgtgggaaggaggtaaagagaagttaaagaaagacaacagattttaaaattcctatcttactcaaatgctcaaattcgagctggaatacaacccatgcaatctgcagggtgtcagtaagaaacagagcagcagatgagtaggaattgacatctgtggcttgggaaaaaaattggcaaggagagcaaaacaagtagttaaagagctctaaatggccataaaaatatagtcttctgaaaaacacaggacagcttaaattcttatttttattatcttcccctataaagtaatacatgtttaggaggatagccataaataagaaacaaaatagtcattctaaaaagaaataagcatgttgtggagggtggaaatacaagggagtattttgctatatggagtagattactgataatatttaatgtacatcagctatattttgcaaagtacatttcaggttccatgactgatgttgttacaaagcttgtagaattgtattgttcagaaactttctaaggtttatataatttttcccttcagaaaacaaaagctgggaaaagaatgatgcatactgttttctattttctatgagttacaataacaaatgaattatcaagatgaactagagagtaaagatattaagtcaatacagggcccatgattctaatacaattttctatctttaattaaaataaaatagacaatgcacaaatccattatcaaaaatcaaaagtcatattattatattaaatacattttcaccaaatgcttgagaacacatgcatttgatggtaaagacataaacaaaaaatactaattaataaaacaaaacactttctgttgtggtattaaattagacttttcattatttatgatttatagggacaatttataaacatagctaaccccatgataaaaccacccataataacagacatttagatataatatgtatttttaattggatcccatttttataaataagataataaagttatatttttcctcttgcatgtggggtgggagaaatggaaggaaattattaaagagtactattgtgttctcagtccggtatatggtcagttgtgcacataataaattttatcagctttgattttgtgttttttctgatggtagagaaaggcaggctaaaaaatttgctttttgttattcttgctataacctgactacacgtcttacttgttaataattttgagctcatttatggtgttttgattgaatattatgatattacatataaaaaaagcaaactaaaacatcacaaaatcatactcaattcttcaaatttccataataagaacatcttaataagacaaattgcaactatcagagtaccacagttgaaataccaatatttctaaaatattgtgttcacaaaacattttgcatgcgtaatagatgttaaattttagatatatttgaaatatggatctaaaccattttaacatatttactattttttcataataaatgcaatccatggctacaaagtgaagtaaaacattgtagaagtcttcttttctagcccattctctactaagtcccttagtaacagtctgtgcaatgacctatgctgatttatctgtaatccccgctacagaaaatgtttattagttcagttaatttatcatttggctaccttctgcattctctaagatgcagctagagatcatttgtggacccagaaaaccttggctgccctaatttgtactgagccacccaaatggttattacagcagtaggataacactttcaccatggcctttggctgtatttgtatggccattttaattcttcgcagtttgcttcccagtgactcatattcttctcctcagttatttcttattgacatccaagtaaaatactcttgaagcaatggattggtttttgtagattaatgcaaagttgtttcaagaaacctgaattacaggctgattcttgatatatataagggttttggattctactaaacatcctacctaaatacgttttacaaataataaagaggaggctaaatatattttaaaaataaggagtcctggccgggcatggtggctcatgcctataatcccagcattttgggaggctgaggcgggcggatcacaaggtcaagagattgagaccatcctggccaacatgatgaaacctcatccctactaaaaataaaaaaaaattagccaggcatggtggcgcacacctgtagtcccagcttctcgggaggctgaggcagaagaatgacttgaacccgggaggcggaagttgcactgagccaagatcatgccactgcactctagcctggtgacagagcaagactccgtctcaaaaataaataaataaataaataatagtaataaggagtgctatgtgtggtatatagttgactatcaacaaatatttcttgactgactgcatgaactaatgaataaattgacctctcttattttaatggtaattattactgctgatatccaagtttgaattgaacttgtttcatccagttttaattcatatttttaataatctgatataacttgcctcaaagcatgtattttacctattggggctatagtttctgcttggtgagaggctctacagtatttcaggcatttagcaaatatttattgagtgcctactatgtgacagtgcgcaaaatcaagttatttgatagcggaccttgaaaagctatatgcttacctatagtgctgactggatctaatactgattcttgacaaaataaggatgagtcagctaactaataacttatactgagttgtttaaagttttagccttctctaatgaccttgtttgttgttggcttttacctgctgtaatctgctagacaggcctgactccctgacttgaaagacataaaagaccccattgaaaacttttgtgggagttctacaaacaagatttctcatatatattatattatcctactccagacaaagcatacactttaggatgccgtttctgtaagtctctcaaagccctaatacttgcttgtgttttctttctcctgcagtaacatattgttttcctttaataaagtcttatatggaaattcttggtagtgttttatcagtgtttttaattaactaaactgcataaaatttgtagccaattatggaatgagttgatggaaattcaatattctacaaaggcagatattgcactcttttggaacaaacagtgttctctttctacctcattctaccctctctgaagacaatcttggtcttctcccacacgtttatgtaccaaggatatgttattttcaatggaggtaataaaataaacctagttttattttctctatattttgtcacaagagtttcactcttgtataattaatggttttataagaacttttagaaagttgaaaatttttccagcatagcaagataacatgtgaaaaagaacttagaatagaccagtaaagatggctctgaccttatgtaaatcatactatagcatcttttgcctaaaaaaagaggtataatggtttcatgtaggaaggcaccagttttatgaacaaaactggaaaaaatttagtgctagaatatgggtacttaaagtattatttgatgactgtatttggagatcacaactgatagctgggaaatttgtatttatctaaaaaaaataggactttgaggaccccaaatcttctttgacttattgcaaattatactttccataataaataaactgttcaaattaaagaacacagttcataatttttaaaatattattttaatttatattgagtaacagaggtgtatattttaaaaagcagtagtgatgaaggttgaaaaaatggagaattcctttggtataaatgtttcattctaaataaaaatggttatatatatatttttggaataatcaattttaaatattattaactaattcatttttttgctagaaaaaggtttaaaatcttcactgggtcctttctgctaccaatccaataaatgtatggatttttaacattaaattagcagtcagtagttattctcattacgataatattcagtgatgagtcaaaatatatgattattatgatttattttataaaactaaacagggggaggctgttataacatgaaggcttgctctctcatgtacctgttggtggatacaggctgtagtctgagacctcagctaggtctactagttggaacggctacataggacctcttcatgtaggtacatgtcttcctcaaagcatgatggctgcattccagagaaagcatcccaaaaataacaaaggagaagttcataacttttttatacttggatttagaagacaaatagttttactcttggcatgtgctactgagagaagcagacacaataatttagtgaagttcaagaggaatggactcttccagtcaacagtaacagtatcaacatcacattacaagcacaacatgtgagaatgaatatactctaatgaccctattcagaaagagaaattaactgtatattgctatgactaccctgtgttaaactccttgactctgtatttttctattccttggttatatataaatatataatttccaagcaatttctatggtttgaatgtttttgtcccctgcaaaattcatgttgacacttaattgccaatgcaacagcattgagagatgtggcattttgaagtgattgaaccatgagggcacttccatcatgaatgggattaggtcacctaatcagaggacttgacagagggagattgtccctttttgccattttaccttctgccatgtgagaacagtgttcctctaccttcattctggatgaaagtgccatcttggaagtagagattggatcctcattagaaaacaaacctgctggcaagttgatcctgaacttcccagcctctaaaaatggtgagaaataaatttttctttatgaattacccagactgtggtattgtgctatagcagcacaaacaaagacagcaatgaagaaacaatcttaaccacatgtccaagacaataaatgtaaaagatctatattaaaatatgtcatcaatgaatttcaggactatttaaacatcagaaaaagctgatcatcaaagttcctgtctaaggatggagggacagcaggaaggtcacaatcaaatacaaaatagatgaatggcctgaagtttttaatagaatggatcaaggtttccaaaattttgatgtataatggcatccaacaaacaatttggtgtctaaaaaaatcattcacatgtgagaacagaaaaaaatgctaatattgaagtgtgttctggttttaagtgctctatttttaagagcgatctcacattgtaagtatgcacagtcattgctgaagatacttaatttctttaaaaaatgataaatatccatttgcatagggttagaggaagcatacgcactccaaaagtagggtggaatatatgtgatgattctccaatagtcaaatatattgattttacttttatttcattttctttttggcctcatctttctgttgctcaaagtttttcttaaattctcaagttagagttaagttatccagaatataaacttctcattagataatttttttctctctttctgtgcatttgtgtgtgtgtgcatgtgtgtgtgtgtgtgtgtgtgtgtgtttgtagaatttttcatggatctcagaattataaatacagctgtccattcagcatctcaatttagatttctgatagtcatctatgagtttgtagtagaaaaaagtaaagtttttctcttgcactttttcatgtctcagttaatgatatttcttctactcatcagttgcaacacagaaccttagagtcatctttgttctcttccaatagaccccatatacaatacattatcagtactgtggattcgttctcataaatagattcagaatgtaactattaaccaatatgtgcactgttaccatccatcaatgctagctctcaactgaatacctgcaatagtcttttaaatgatgtcctatgatatggtttggatgtgtcccacccaaacctcagcttgaattgtatctcccagaattcccacgtgttgtgggagggacgcagcgggaggtaattgaatcatgggggtcagtctttcccgggcaattctcatgatagtgaataagcctcatgagatctgtgggtttatcaggggtttccgcgtttagttcctcctcatttttctcttgccgctaccatgtaaaaagtgccttttgcctcgcatcatgattctgaggcctccccagccatgtggaactgtaagtccaattaaacctctttttgtttccactttcacatatgtctttatcagcagcgtgaaaacaaactaatacatcctatttccacaattatcagcaccacttccttcgtcccaggaaatctttccttaatataaaactagagtgaatagtttagaagtaatgaagatcatgcctttaatctaaaatttctaatggatttttgtttcaataaaataaaatgaatatttctgccatgacttatatacttttcaaaagccaaaagctgcttttcttacgttactttttggactccattttctgtcattcttgcatttttacctgattcaattacctaacccttttgcccttctccaattaggctaagtacagttttacctcagaatctttaaacataattttgtctgaaaattttttccattaaacaatcattgcatacatcctggctaactgtcccagtattaggaaagccttccttaattctccagcacactctgtccccaatgcactatttcttaaaatcttttcagtgtttttaaaaattatctgacacactatatatttattttatcattcatttattatatatttccactacaagaatgtaagttactgaagtgtaagactttacctggttcagctattgttccatttccaaagcttagagtagtccctagtaaagaatagctgtttaatagctatttgaaaaataaataactcactaaaaatgtaatgtgataaaaatataaaataaaatttgttagattttcagtatcctaactcttgattatgtaattctggctaacaaaaaactgagaaagtgtttgaattttagatatttgtgaatgagtttgatgtgccatattcaatcaaagttttaaaagcatcaaagtcaggaatctcttgtttcttggctctataagtgcactcatcccaggatcactctttttggctcaaattacaaaattttagtaaatcttttgtgagaaatattgtaagccccaggaaaattcattctccctacttcatgttttctctttataacttttgagtgatttatttcatgatttggtaataaaggtaaaataaaatttgcttcaattttgaatatttgtaaaatgaagattttattaaaataatttgtgaataattttattgattcaatagaacattttttgattcaatcaataacattgattgattcaagagccccaaggaaatcttttctttgaggttttgatggtgttcaactgtaagtcctcaggacttggtgctttcattgggataataattttttaacaatatcttttaatattttctattttaattaataaatttactatgacaaattttattctctctgtctgtgtgtctctggttatgttccctaatgtttgtattaagacatctttattttaaaagactagatctttaaacttgatatcaacatacccaaatataggctataataactacaattactttaatccaaaatttcatattaaaatagaaaaactgctactatgcatctgcatgcagattccagtgaaaatattaacattgtaggtgaatctagataagaagttgtagattgcacagcaggcataaacagccagtttcctgatagcatcttattttcagcactaattttttaaatggattgagaattttcactatatttttcctggaatagttaagggaaaatgactttaataacagtgaacattcctgtgaaaaaaataagtaagactaaataagagacctagaaaatttcatgtattatagaatatatgtagatgataacatacattgaaaaatgcaaaactataaaatatataatctaataatccacataccctaaataaatagaaagacagtcgagaactccttccttccttgcatggagggaagagtgtgaagtgagcacccaactttgctgtgaaccccagcaccaggccaccccagtgaaactcaagcagaccaacccttactgccccaagttctggtatctatggactgaacctccaggcctaccccgatatcaggccagccccacagcgtcaggctccaggacagaatctgattatccagcttttagttctgtcccaatgtgaagccagccctcacagttcagctttcatgtcagcctcacagtctcaggattcaggcccattctggcaccaggttggtccccacagccccagactctaggctttccccactaaactcagactccagaactttacctgtacaccccggctttagactttcccccatatctcaaactccaggtccatcctggtaccagtccagcccctatcaacccatgtttctggctgctcctatagacataggctccaggcctgcctccatggacccaatacacaggtatacctcagtagataagagtgccagactagacacctgaggatccatgcagctgagaagatcctagctgcagtatcactatggtggacccaagcttcagacctataactgtggatccagggcccaggatctatgctgggccctttggacccaggcaccagaatcaccccaccttctcacccaggtaccaagcctgcccagtgatttgggcagcaggcccatctgaggatcccactagacaacctgcccagaatctctggaccagctgattggtgaagggctttccctaccatagccagtctgtaaagactgtaataggtgcctaattcttcaaatgcatagacaccaatgcatggtgatgaggaccaggaataatcaggtaatgtaacactgccaagggaataaaataaacaatcagaagctgaaccgaaaagaaatggatatttataatctttctgtcaatgaattcaaaataatcatcttaaagaagctcagtgtgctacaagagaacacaaatagaccactaaacaaaatcaggaaaacaatatgtgaacaaaattagaaattcaacaagaaaaaaatcataaaggagaatcaaacagaaatatttgagcaaaatggcacaatgactgaactgaaaaatttcatagaaatcttcaacagcaggtttagtcaatcagaagagagaatcggtgagttcagaaacagatcatttgagattacctagtaagagggacaaaaataacaactaaaagaaatgaaatcaaatgaaggaggcctataggaagtatggggcaccatcaagtgaccaaacatatgcattatgagagtcaaaaaataatcagaaaaataaaataacaggaagcttatttaaaatgatgggaaacttcacaaatctggagagaaaaatgaatatcagatccagaaagtcaaaataaccctaaataagttaatataaatagatctttattgagattataatctgatatatatcatatataatatatatcgtatataatatataatatcagatatatactgatattataatcaaattcttaaaagccaaggaaaaagagagacttttgaaagcaacaagaaaaaacaactcatcacgtacaaaggaatctttatgacactgttagctgacctttcagcagaaacattgaaggctgggagagtatggaatgatctattcaaaatgctgaaggaaaaaaaactgcctgccaagaacagaatgtcaagcaaggatgtccttcagaaatgaaaataatatactttcctcaacaaacaacagctgagggcaggagttaattaccactagatttgccttaaaagaaatgctaaagaaagttctttaagtggaaatgaaaaaatactagttgctaacatgaaaacacgtaaatacataaaactcactgtaaagataaaaatacgtttaaactcagaatactctagtactataaaaatggttcttagatcacttttaactctaacataaaacttaaaagatgaaaatactaagaataactatagctataataatttaatagatgcacgagaagaatttatattgagataacaacattaaatgttgggagagaagttaaaatgtaaatcttttatatacggtcaaaattaacttatcctcagcttaaaataaagtattataactataatatgttttttctaagcctcatggtaacaacaacaacaaaaaaaaacctatagtaggtacgctaaaggcaaggagaaataaatcaaatcttaccactacaaaaactcatcaaatcaaaaaagagagaagaaagaaagaaaaaagaaaatacaaaataatcagaaactaacaaaatggcaataataagtccctatctcttcatcagttcttcaaatatattagattaaattattcaaccaaaagacatacagtgaatgaattgatttttaaagattcatctataatctacctataagtcgctcactttagattcaagaacagacataagcagaaagtgaagggattaaaaaatttcatgaaaatgaaaggaggtgtggctatatttatatcagacaaaatacacttcacgtcaaaattatcacaagacgcaaagatggtcattatataataaaggagtcaatcctcaagaagatgtaacaattgtaagtatacgtgcacccaatgttagagcacttaaacgtataatgcaaatattgacagaactgagggaagaaacaaccagtactacaataatagaaagagacttcagtaccaaactttcaatacacaggtaatccagacagaatactaataatgaaacaatggatataagcaatactatagatgaaatggacctaacaggtacatacaaaacattttatccaagaatactagaatatgccttctttcccaatacgcagggaacatcctctaggatagacaatatgttaggcaacaaaacaaatcttaacaaattcaagaagattgcaattataacaagtattttttttctgaccatgatggtataaaactaggaattaataacaagaggaaaattggaaaattcacaaatatgtgtaaattaaacaaacactcctgaactatcaaaaggttaaagaagaaatcaaaaaaagtaaaagaatttacagtgataaactcaaatattaagaagaaagatcttcaataaacaacctaacattacaccagaagaaattaggaaaagaatcacaaactgagaccaaattcagaagaaggaagggaattataaatgtcagagcagaaataaaattaagaagagtctcaaaaattaatagaaattatccacaaaacagtttttttaaaataaaattgacaaacctttaggtagaccaactaagaaaagaagagaagacaaaaatcatcaatgaaagaggagatgttacagctgccagcaaagaaacaaaaagggtataaaagagcactatgaataattatatttcaacaaatagaataatttagaagaaatgaacaaatgtctgaagacatacaacatatcaagattaccatgaagaaatagaaaatatgaacaaattaaagagatgagtacacttctaaatacattttatgaggccagcactacccttatgccaaagccagacaaagacactacaagcaaatgaaattacaggccaatatctttagtaaacttatatgcaaaacattaacaacagaaattaaacaagacacaaacagataaaggtatatcccatgttcatggattggaaggctacataatgttaaactgcctgtactacccaattttatatacaaatttgatgcaatctatatcaaaacaccaatgacatttttcacataaatagaaaaaacgtctaaaattaattggaacaacaaaagatccaaatagccaaagaaatattgaacaaaagaacaaagctagaggcatcacattacctgatttcaaaatatactgcaaagccgtagtaatcaaaacatcataatactggcataaaaacagttatatagaccaatggcagggaaactaacagataccaaaactaaattcacatatttacagtaaatcaaattttgacaaaggtgctggaaacattatgggaacaggacaatctattttatacatgatgttggagaaaactgggtattcacatgcaaaagaatataattgggcccatatcacatgtcatatacaaaaatcagtttgaaatgaattaaagacatatacgtaagactgagctataaaactgctagaaagaaccatgaaagaagtttcttgacattggtatgggtaataatttttttattattacccaaaaagcacaacaacgaaggtgacaccaaacataagatggcatcaaactaggaagctttgcattacaaaggaaacaataaacaaagagataacttacagaatgggagacagtatttgtgaaccatacatttgataaagagtcaatatctaaaatatataataaactcaattcaatagcaaaataatgataataatccaattagaaaggggcaaaagacctaaacaggcagttcttaagaaaagacttcaaatggccaatggatatgtgaaaatatatgcaacatcattaatcaaaagggaaatgcaaaatcaaaccacaatgaaccattaaaaatcaaacctcatgactattaaaatggctgttatcaaaaaagtaaacaataactgctgctgaggatgtggatataaggaaatcctagtatgcacttagtagaaatttaaattggagccatcattttggaaaacaatatagtggctcctcaaatttttacaatatagaaagataatttggcaatcctatttctgggtgtataatcaaaggtaaaaaataaaatgaatgtagtaccattcagacttaaaaaaaaatcctgtcatctgcaaaaatatgaataaatatgcaatatggcatgctaagtgaaataagccaatcacagaaagacaaacagcacgatctcacaggtggtctctaaaatagtcactcatagaagcagaaagtagaatggcggttgacaggagctgtggtggtaaggtccaggggaatgaggagatgttgctcaaagggtgcaaagtttcagttaaacaagataaatacgttctgaagatctactgtagagcatggtgactacagttaataatgtactgtattcttgaaaaatgccaacaaatatcttaaatgttcacaaacaaatgaaaagtatttcaagtaacagatggtagtagcttgatttaattattcacatgtatacatataacaaaacactgtaaatatatttaattttgaaatgttaatttaaaaatgcatataagtaaatataagaaaacaaagtaaaaaatgtgaaataattggagaggtaaaaacaaactgcaagtgtttacaaaagcgagatgatatatgaaaaacatctgaaaagtaatctccagataaatattacaatcattcagatttttttgatatagctgctatatatgaaaattatgtaaaaatagatattttatttatgcagataatctactaattagaaaatgaacttttaaaaactaccagttataattacatcaaaatatatgacatctttaaagcacatgcaaccagatatgggaaagataatcacgaaacattttaaaagctattagaagttattaaagaatgatgaaaatatagtttttaattaattgtgccattatctgtgtaaaaaaatgtaaaatcaggaaagcttttgtacataaaagcaattacaagaaagatacagagacatgggaaccctaattcattgctaattgagatatcaattggtaaattcagtttagaaaacctttgacatcatctaataacatttaaaataacacatgtcctattatgccacaatttttatttctgctgtttataaaacttcccctatgaacaccataatgtacatactagaatgttcataagctgtagattattattgccaaaactagaactaacttcaatatccctcacaaatattatagctgatgaaataagtgcatattcaattagactttatactgcaataaaaggcaaatggtagcagtgtgcaggaacatggatgcatcttaaactgtaatgctgcaggaaataagctagccaaaatgaacttgaaaagtatgattacattaatataaattcaaaagatgcaaaacgaaattatagtttagagatgaaaacttaggtgataaaatctatgaagaaaatcagaacagaagaaaatcagaacaaaagggaatcagtcaggaaagtatttatctgaaggcagtgggcaggccttataattaaaaaaataataatttagagatctaccggcttctaatttctgatcacaggaattagaatattgtttacacaattgctcactttatttctacattgcacttaaatactttatatacatgttattctgtatgttacatttaattattgaaaaaacattagtactgagtacatagaaatgtaaatgataaaataatggagatctttgaatgtgggaaatgggaaactgcagacaacttttgacaaacaagctattaaaactaagtacagaatctggtcataattaactgtgagggcaatgactagttggtgctaggatacagatttagcaagagagataaaggtggaataatcttggatatgtatgaggaaaacaaggagctttaaagaagacaagaacacagatttcaaaaagaaagagatacttaataacagttaaaatattgtatttcagtattttgaaatacaagagaaaggtagaatactgaggattgggaagaagaaaacactcatattgttgatcagtagatgaattcattatgttttgtcctttgatatatggtacgttgtaactggttcttgctccaactagagtcaaagggtttaaggagtgtgttgtataaaacagacacacagggggccgggcacggtggctcatgcctgcaatgccagaactttgggaggccgaggcaggcggatcacctgaggtcgggagtttgagaccagcctgaccaacatggagaaaccccgtctctactaaaaatacaaaattagccgagcgtggtcgcacatgcctgtaatttcagctatttgggaggctgaggcaggagaatcgcttgaaccctggaggcagaggttgcggtgagccaagattgtgccattgtactccagcctggggaaaaagagtgaaactcccgtctctaaataaataaataaataacagacacacaaggaaagcaatttttctcaggacaatggaagtttatctgaagtgttgtgttctcccatctctagaagcactgacgatatttattctcttactgcaagacctgcccagtccaagcccccaaaccgactttggattgagataggagactcttagtctactccatttacctttcagcagaacttggcattatgtcactgttgtcattttagccagatccaggaaacaccaggaattgatattgtctgaatccaaacagtttgaagaggcccctccagagctaagatccagagctccaggaggattttcaaagcctgctgcaggtatctctggaactgggaggaaaggtctctaaggagagaaaacttccaagaagttactagtagcctgcacccctgaagaggcatgattgagcagttgtagaagtataaaaagaaggtggcattggtggaagcaatatataataattacaggtatattctattaaagaagaaagaaaaataggaaaagttctatgtaattattcacttttttttttgaccacgtgccagttaaagtccaggcacttttggaaggcatctgcaagcttgtttcctgaatccatattgctatttcttagaatttaggtgagaatacacttctatcatgtaaattcagagatttggagatttctctcttaaaatacctattgctactctaacatagaattctgaaatctattgatatttcaatataggaacctgaattatttttcctataagggccaaatagtaaatattttaggttttgtgggcaatattgtgtctgtgtccactactcaacactgccattgtaatacgactaactacagacaatatataagtgaataagtgtgacttgttcccaaaaatgttaattacaaagtagatgttgggccatatttggcccacaggctatattttgctcaccctttctcgaatgcaatagacaatcctagtgccttagctgtatttcatctccctcattcagaataagtgctgttaagatttaaagaaagaagggtagatgttttcatatggaatgaaggtaaaggaagttaccaatattaaatcaatcaagttaaatgtgtagatccagaagaaaggacaaaatatggatggcaggtatacagaaaagaggaagagtaggtttaattgatgaagcaggacctggaaggggttacgaagccaacatatgtaaaaactgtaactttggaaaagaatgagacatttcttgctggaaacagagaaatggtatgaaaggtggctaaataaatgaaagtcttacatacgatgaaaaagatatcatcagtgaagagtggaagcacaagcagatctcactggatacccaaagatagtactgtagttagaaggaaagaattttaagacattttacaaaattttataatatttaaattttaaattgagataaaattcatataacatcaatttaaccattaacctttttaaagtgtacaattcagtggtattaagtccatttacaatgttgtgcaaccatctcccctatttagttctaaggtgtttacatcattctaaaagaaatcccatactcattaggcaatcaatcccatcccccttctccaagccccaataaccactagtctgctttcagtctccatgtatttatctattctagaagctgcatatgaatggaattatataatacatgattgttgtatctggcttttttcacttagataatgcttttgaggttcccctagttacagcatatataactactttattcatttttaatgactgaataatatttgtatgaatccattctatttcatttatttattatcttctgatgaacacttgttatgtttccaccttttggctactgtgaatactgctgcaatgaacattcatgcacaagtatttgtttgcatggtcgtttttaattcttttgagaatatacctaagagtgaaatcactggctcatataataattttatgttcagctttttgagacaccaacaaactactttccatagcagctgtattttgcattttcaccagcaatgtttgaggattccaatttcagcacattttcatcaactgcagaaaagaagaaaatatttgcgaatcaaagatctcataaaaatctactatccagaatatataagaactcttaaaacttgacaaccaaagacaaagaaccaaattttttaaacgggaataaaatcttggatagctgtttctccaaagagatgtacaaatggctaaaagttgctcaacatcattagtcactggggaaatacaaatcaaaatctcagtaagataccacttcacacacactaatatggcaacaataataatgacaacaataaaaagagaatataatgtattttttaaatgatccaccgtagagtcaatggaaggacagaacattcattttgctgcttaagttctgaaaaaatctgagatggtttaaatgctgaagttaagattgaaggaatgggagtattttatacaaatattggatatagatattgcaataattaggctgttggggatgactatgggtgttagaatttaaaatctttgaatcaaagaatagttcagggtgatgtgatcaaagtgttatttgcccatgtaagtgagtgaaacctaatatacataaaattcattgaaatttgggaattaaaaatgataattttaacatcccctatcatagaagagctaatcgccttccatgatcacgcccttataatcatttttctaatcagcttcctggttctatatgttctctttctaacacttacaacaaaactggctaacactagcatcacagacgcccaagaaatggaaactgttagaagaaaaataaaaaatcaataggaaatcagtagtcattgacatatatggcaatacacatctaattacaaagaaaatgaacaagatattgatgtaatcctgggcataaatagaggtaatgaaaatagaaagtcatgctaaagtgccattacatctcatgaagtaatttaatcggtagtgtcagatcaataatttgcaaatgaaagtgaattaataacatgctgatccataacaccatgtttatgaattaggggagtgggaagcacactgtccatgactgaaagagaagctatcaccagagaagaacacaggatcaaagaaataatcgcaaatgttcaagaccaaaaattttgttcagtatgagaatgcagacttcctagggcaaaatagaaagggtagaagagtgactaccaagaattgattggttagacaggagaatcaacaaataaattctgaggtttttggttttgttaaaagatagacagaagtaaatgtgctgcaaaaggtgttttcagacatcatttaaaaatgtaggtaaaattaagttggattttctagcaccattgtaacaggtgatgtctctgtacttcctgcagtgtgacacttccaatacctcaaattccttttacacctgttactttgtgttacttttacaacttcctagtgatataggcagtttagtgttttagcctcatgttatctaatatataacataaagtaaactcaaagtggcaaagtaatttgaaacctaggaatcaaaactgaatgccccaatttggacttcatattttctacatcaacaatattttctcaggtattaattttgctggaaattatgaaatatgttttctgcaaagtttatttgatttcattgcagtaatcctctatgaataggtcttacctaaaagtttataaagcttatttgagttaataatacaaacttaattggaattgatagcttatacaaatggaaatctctgtggttgaaaaaataaataatttatctcctgaaatacaaacgcttatgtattgatttcgaaataaaatgaaacaaaaacccaaggacagaagggcagtagatgttttcctctaggaaaaaaatgcagctgattttacattgtgggtcccatgaaaaagattgtgtcacagttagtgacatatcagtacaagtaacatcctagaatcacaggactgttatgaaatgccaagtatggtaactggctaaaatgagaaaaaccctttttattcagatgtgtgtttcacaagtattattttactttgagcatgatctttattgaataacatttagtgttttacagttttctaacaggaacaggaacaggacatcacaaaaatttgtttgcattttggtaatcacatataaccagaactagagtaccactgaatcaaacacatttgcaactgagaaaaatggcttttaattgaagtgaatcagagtgaatcagaaatactaacgaaacaggaaaaaatagaaatctaaatagatatttgcattaaaatatcttaattattactgaaatttgtgcagagataatactgtatttgctttaaaacagtatgaaaaaatatggctttgcgagtcatttggtttgtgatataatgaaccaaattgcttgctgaaaatttggataaattccagcgcaacagccactattcaaattgatagtgacagctcattctgagggaaaaatgttattttcaaatgattgatatgaactcaaaagggtgtgaagaactatagtgtactttgtacataggagttgtgacaggttggcacatgtctaattctgatttaaaacaagccaaggccctgcagtttccaatgccattaagcttatataccacatgaaattatttgattcactggaatattccacaaagcaaaatgtgccaaaatttcaaaattaaaagtctgatttttatattagactggcatgtcatctactgaaataaattcgaaaaatttcttccagtaataggaggaaaatattcatacatattaatcaaacttaattaacacttaataaatgctgctctctaattgtgaaatttaaaagtgtaccaggtgaaagaaaatagagcccctgccataaaaggaaggcattaaaacttgacattgataaaatgaggtcattactctttggatgaaaaatagggctaaatgcagattaatggcaaaattcttcaattccgctcttttagattttactgatttggcatgtatacattttaatttcttaattgtattcccaaaaagaccaattagtgtttttctgatacacaagcaatcaaaggataatatctgtagaaaaatttgggttttttttttttaattctattttttcaaggattccattgtcacaaagcaaaatcaccttactgaaacccatgctagaagtgacttttctcatagttgtgacttcctaaaaagcttaaggttgttgtgtatttagcaagatgttttaagcattgtcggtccctttttcctaatttatatgtggtatttatcatggactgctgttttagttcaggctagcctgctatagtataaccccacagactgagtggcttacaaaaaaacagaagtttatttctcacagttctggaggctggaaagtgtaaggtcacggctcaggcagattcggtgtaaggtcacggctcaggcagattgggtctggtgaggacccaattcctcacagatggccttcttctcactctgttctcacatggacgaaggggcacaggatctctctggggtctctgtaatcagggcaataatgtcatttattagaactccaccttcaggacctaatcacctctcagaggccccacctcttaaaaaccttgagggttaggatttcaacatataaattttgaggacatataaacattcagtccattgcaactgctataaacaatgttggccagaaatcaaaagggaacatagatcaaggaaatagctatgtatgtatgcttttgcatattattctcttatgtttcaatgaaagggacaggaatcaaatgcaaagtgttcagagtctaactgagaaggtcaagctataagtagctttaggtaaggcttgagaaaagcagtcagaaatattttcaggaatatacctgtctgtattttggctccatgctcttatgggcagactccgttctcttgaaggatgtttctatatggtggaacaaataaacaccagaaggtttaggctaaaatgtatctttactcttaacaatctttaaaagaaaatgtcatctttctgtgtcctttcaattcagtaaaacaaatctgactgtcccagtttgtgtcatatgcccttttctcaaccaaaaaccatgcccacagggctggcagatactggttgacctggctcataattctaccgctgtgtttcttatgctgaaggcctcacttgaccacatcaagtgagggaggaactatccccaaaataaacatagattctgttactagaattaaaaaaaagtgatgttagacattttgaaagaaaccatgaaatagacaaattatttccctgatgaatctctttaatattattgtcttcaatactgtgaaattcccattttaaaaattttacatttatgtttatacaaatatcatcatctccaaatgttgccaggtggcaagttgcttatcatgtaacttaagaaggaaaagcctattgtggtacaaaaacagatacacagaccaatggaagagaagagagcccagacacaagcctgcacacctacaactgtctgattttcaacaaactgacaaaaacaagcaatgggaaaaggacactctattcaacaaatagcgctgggataactggctagccatatgaagaagattgaaactggatcctttccttacaccagatacaaaaattaactcaagatggaagaaagacttaaatgtaaaatccacaattataaaaacactggaagacaacctaggcaataccattctggacttaggaatagcaaagatttcatgacaaagacacaaaaagcaactgcagcaaaagcaaaaattgagaaacgggatttaattaaagagtttctgccctctttgtgcagaaacaaacagaatgttcaaaagaacttaaacaaagttacaagaaaaaacaaattaccccattaaaaagtgaacaaagaacatgaacagacattttacaaaggaagacatacatgccaccaacaagcatatataaaaagctcaacatcactgattattagagaaatgcaaatcaaaaccacaatcagataccatctcacagcagttagaatgactattactaaaaagtcaaaaaataacagatgccggtgaggttgtggagaaaaaagaacggttatacactgttggtgggattataaattagtttaaccattatgagaaacagtgtggcgattacttcaaagacctaacctaaaacagaaacaccatttgactcagaattcccattactgggtacatccccaaaggaatgtaaatcattctatcataaagaaatgcaggcatacgttcattgcagcaccatttacaatagcaaagacatggaatcaacctaaatgcttatcaaaggaaaactggaaaaagaaaatgtggtacatatacaccatggaatactatgcagccataaaaaacaacaagttcatgtcctttgcaggaacatggatggagctggaggtcgttatccttaacaaactaatgcaggaacagaaaaccaaatactgcatcttctcacttataagtgggagctaaacgatgagaacttatggacaaataaaagaaaaaaaaagacactgaggcctcccactggagggtgggaggagggagaggattagaaaaaggggggggggtactaggcttaatatctggctgtcaaaatagtctgtacaacagaaccccatgacacaagtttaactacgtaacaaaaatgcatatgtacccatgaacttaaaataaaagttaaactaaaaaaagaaattcactcattaaacaagaggtgagtttttcactaaaagtaaaatcatatttatgccttagtatacccgagcaggtgtgcttggttgtgttttactttttgaaatatacagcagaactttcatttgtcaaagtgcagggttgtttactttaactgggagtattagaactgggaaattgagaggaacagcttcgatggagttcttcattaagaaaaatgataaattgctaaaacttaaaaggtgtttcaaatggatcaaatctgtaaggataaatgtctagagttgacagatttagtttaaaaccaaatgatttaagatgcataaattcattatttttattttttatctgtgtacattattctactttgtggattgcttgaagtcattcatttcaaaatgtgcctggaacaatcacataagtcacatagtctaaaaaggccatcaaattacccattcttccacatatatacacataacactgaattttctcatcaccgcataattctaattacaataaacatcaaccctagtttatgcttgcaagctcagtggtcaggagtaattatcactttaaatccaataatctttttttcctttttctttttttatttttggtgttcactaagaaaccttaatcaatataatctgaggtcttaggtacataaaagaagccaaggaatatggcacagagaaaaaaccagcagagcatgtaaaggctgagccagaaatagaaatactcaacttgaactttaaaaagcaaacttgatagatggtgagttatatttgctctacgaaggcttaagctgtgtaaccagtacaaatgcaccagcaagttaaaattccattgaccttggcaatgtcagaagggaaatatattcatggagatcagctctactgaaattaatctcatgtgttgataaaatcaaagtgatgcttccttctcaaaatgacatatttggcttcttttacctactgcatgcttggggcagaaaaactagtcactgtggcattgtggtctttaaaaaaaaatctaatttactatttgtcacagtaagtcaatcatggggtatcagtgctgtgaggcggtttagaaatctatgttcctttcagtctctcgttcagagtctacaaaagtcacctttaagaatttagtgaccttttacactgaattttgaaaaaaaaattcattcttttaaacatgtatagatatgaaacttcaatttctactctaagattgaccaatatctttattagtattttaatgttgtttattaagatttaagagcatgattctggacagtcaaaagagatgcaaaaacatacattctaggtgtatatgtttaaagttttcattttaggacagttgtagattgagagagaatttgtgatgatagtacagagaatttccatataacctacactaagattcttgtattattgacatattacattaatatggtgtattcactacaactaatgaactgatgggatacattatttgtaactaaagtctatgtcttattcagaatgtcttcatgtttacttgctgtactttttctgtcaaagttcccgttcagcaaaccacattacgtttagtggtcgtgtagcttaagcttcccttgacagtgacagattctcagacttttcatgattttcatttctttcaaagtgtgaaaagtactggtcagcttttttctagaatgccactcaattggatttttctgatacattgggttatgcgtgtttgggaggaagatcatattggtgaactgccattctcacaatgtatgaaaagatgttccctttcttgagtaataagaaaaatggaagtaaaaatcacaattgctatattgaatatctaccaaaatgtaaaattgagagacagacaatatagttaaggtgaatgtggagtaactagatggagcacacataccttgctgttaagaggataatttggtgcaaccaatttgaaaaattatttgacagaatctgttaaagttcaaagttgcaatatgacggctacataagtacttaatggaaatatatacatattttccccaaaagaaatataaaaataggccgggtgcagtggctcacgcctgtaatcccaacacattgggaggccaaggagggaggatcacctgaggtcaggagttcgagatcagcctggtcaacatggtcaacatggtgaatctaataaaaattattagattctataatttttattatagaatctctataataaaatacaaaattttattatgttttattatttatgcctgtctctaataaaaatacaaaattagcttggcgtggtggtgcacacctgcaatcccagctactcgggaggctgagacaggaaaatcacttgaatctgggaggcagaggttgcagtaagcctgcaagtttcttgtatcaattcgaaccccgagagtgcgccaacaaacaacacgaggcaatgtggagcaacacgctgttttcatgagcgcctgggtgcaggcgcgctggggtctaaaagggcatcagccccaagtgaggacgggacatgggtttcatagtccactgtaaacaggaagtgtcccagtctgacgtgactgctacgtagtacccggacagcctccctctggatcttcagggggtatgtatcttcctgcttctgctatccagctcttcctgcttctgctatcttgctgactcactctgctggcacaagtggtcttgcgccttgggactggtcctgaggagggggcagttatccattcccttaagctttcaggccccggggagaatctttcagagccgagatcgcgtccagcactccagcctgaatgacagaatgagaccgtctcaaaacaaaaagacatataaatataatgcagaacaatagcattccaaacagtataaacatgaaactacccaaatagtattctacataagaatgaatggtatattgtttggaatgcctagctgctcatttgcactaatcatattttaagtactaagtacccgtatgtgaataatggctactgttatattacagcatcaatatagcaggtcagatatagaagtactccaattctgcagaaagttccattgtgaacattgagaatgaattatttgaaactatatataagataatatggatgaaactgaaaatcaccatgttgaataagagaagtagaaataagagtatatgctgtataagtttatttatataaaatccagaacctggtaaaatgtgtctatggtgctagaagtcagtcggattctccttagagggtttagtgtcctaaaaaggcaaagcagttaactgtggtcctgtttatgttttctttttaaaaatctaaatgctagttacatggaaacattcagttggtgaaaattcattgaagacaacacctatgatttgtgtgcctctctgcatggtttatgatacttcaatatcacgtttacaaatagaaaaaaatatgtcacactagcaaggattactacttatgcctcaaagcagttggatatggaagtatttcagcatgcacaacaaaaagacaaacaataacagcaacaactaaatcagagctctgagtcagtgattcacagtagttgctcaataatcagcaatccacagcacttgagatggtatacattttaattttatggagagaggttgccagtgccttccacatcaggttccattcacatacctgcttccatcattcctctctgctgtggtcctgtaacgtagtatcctgtatgtgttagagtcagtcattatgcttttcagactttattcacagcttttattcctgcctgccataagaaaagcattcaaatcatgcaaatatatctttaataaggttacaaatactcttctaaatagtaagtatttcaaattcagaaatttcattcatcttttattataaatatactgtgccgataagtatgcatagttaagtatttagtaagtattactaaatatatcaccattgatggtcttaggatatgccaatttttattatatctgttttagttaaacttcctttggccctgactctgaaacttaaataccctaaaatgtatcctctgatttgctttgctttgtttccttatttgcaatacacatgtaaataccagtctttatttatacaaattaaaaaactcattcattaccatgatcgaaaatagatatcaaagatattgattaagtagacattaaagccaaaggaagaggatgtaagaaataagattaagtcagatataagaaaagtacaaaaaggcattttgaaattctagaataattgttatagggaagcaatacagatattttactataaagttttcatctctcaatttgtgaagcataagcaagtccatgattcaaagcaactgtaggaaactaaaacaaacaagtaaacaaaaacatgtgttaagatttactaaacaaccatagagaacctacaggctggacatgtattccatggctggctggccacagaaatattcatttacacgtataagtaataaatacacataagagttttgacaaatgatccgggagggagagctacatcagtgcaatgaaccccaaacccccacttattaactccaataaaagaaggttaaaaatgcaaggttacatatttttaaacaactattaggtaaactctaagaataataatgacaatgactatctagaatgacatgatattttctagtacatggggcctaagtgaactctgcatttaatgtatagtcagctaagagtccaaaacatattttggtgatatctttaggtaaagaaatgaaatttataattatcaattcagattatattctcttaaaagttagatactgtaatcttcttttagtgactccaataagactgctagatcatcctaagatattttttcttctacagcaatacatttataacagaattcttaatagaataaatatccttggcatctgtggagaattaactagtttgataacatgagtttaatagttactggttggtaaacttaggcatgtttcttcaccactgaatgtgttagttttctcatctataaaatggggagaataataagcagctctttaaaagtttatattgtacaattaaatagatatttgtaatgaaaagagaattaaccaacaccctaatgtgtagggttcctgtttcttttgtagctagattaacacaatctgcatttaatattacaactatggtgaatactaatgattgaaattctagcagttaagctccagaatctaaactttgcaaataagctcttcttctgagagtttaatatgttatctttaataagtatggatttattctatatacatcaagtatcttactgtaaaaaatacgattattaatatagtatttatactgactgtaatctctaagttgcttttgtgaatatagtcgtgctatcagtctgtttattatcatttgtttcacataaaattataaagcatgaaataaattccagttgtttggcttctcaatataagttatttctcagtagacgctattaacaaacagaagactaaacaccatattttaaattacatttcagaatactcactggaggtaaagtaatttctgttgcttgccaaatgtaaatttacaattcatgcagtgagttgatagaactagagctagtttcgtgaatgtcaaactgtcagtggaacagttttaaaatttacagcctataaaagaactcacagacctattaacaaattgagtgcagttatttcagacagaatcctaaccagttcaatgaatttctgtctaactcagtggaatgatggctttcattttagtgcttttgttattctttttagttcatgtcacgaaagtgttttttttttttgacattacaaactatttgtgtaaagagtaatattaaagatttgagttgagtatactgatgtatttgccatcacattccatttctggtaagactgttagttaatcgaaatgaatgaaaaaaaattttctcaatgtagcccattcagaaaagatggatattataataatttcaatatttatttcacgtcttgtcccagctaaaacagaatccaaatcctgatgtttagtttcctcgaaatcatataaatatctacattagttttaatataatggaaggaatgcaaactttctttttgcaaataaataagtgttcgtaagtctacctgctgccaaggactaaaaagaagagtggttctagttttcccttgagtttacctttaatattataactggggaatcataaatatctcactcaaatagattaataggtgtgtaagcattcagtgcaaatataaaactttaagttttcccaagttctacaaaacagaaagtataggaatgtcacaaagatttatcagacagcttgagttcatcctcacttatttctttgattaagaaagaaatcatggccgggtgcggtggctcacgcctataatcacagcactttgggaagccaaggcgggcagatcacgaggtcaagagattgagaccatcctgcccaacatggtgaaactccgtctctactaaaaatacaaaaattagctgggcgtggtggtgcacacttgtagtcccagctactcgggaagctgaggcaggagaatcgcttgaagccagtaggcagaggttgcagtgagctgagatcgtgccactgcactccagtctggcaaaagagtgagacaccatctaaaaaaaaaaaaaaaaaaaaagataaaaagaaatcatgagaacctactacttcctactacttataacgtgacatttcagtcatttagtgtttcaaagattaatgaaatattaatcttcctcagacagcttagaagcacaagaggatggtagataggtaagtcactgaccagcacattcaaatctctatttttgagtttctgaagagaatatttgttttaagacatttcctctttgatgtgctagtgaaaatgaattcaactcaaaaactgagctcatcatttcctctttttgatccctgactcaaacccacttcacccctgctttctctaactttaaacatggcaccagtgctcacccaattataaatatatatatttaaggatgagtccagctcttcactttttccctcagtaaccttggccaaccatttactgaatactatcaatttcactctcaagtatttttcaaatttcttttcacctatggattcctgccattaacaatttactttcagcagatcttcatcttgaatctccaggattactacaaatatttcataagtaatctctctgctcaatgtatcttccacctttacatgaatttttcatactgctaagagagcgatcaagcaaaaacacatatcaaatcatagaaaaaaacattttagtagacaatccatgacctaattctttctatttctcaagtccaatctttcatcatccttttatttgcacttcaaacttatgtgattctaaaacctcttgtttctcccaaacctctagaatatataatgatacagtgacattggacatcctggttactttgtataatgttccccctagttagtggcatctaatgaatgttcattcaataatattattcaagtggtttgtgtgtgtgtgtgcgtgtgtgtgtgtgcgcgtataaaatttacctcgatctttccatagagataatttatatctctttagtatagttttttctatcttatacacactttacattgtttatgtgtggtctcaaatttactgatactatattcagatataaagttaactcattttattccttccttgttttatttccttttaagtcattcttctccattaaaaatcctcactgtgatgagagagatggggatttgttaaaatccagaaaagtcattctaatttaataatttttatatacccataagtaatgcagtttctattagataaaatgttcttttaaaagagaattttccatacgtactttattgctgatctccaagatatgaagtggattcacagcggactcatgtgaattatttgaccttatgggggtcaagtaaaagtgatatcctcagtagcctctgattagaaatcactcgtccagattttgttcttagttgatacctgcttatatcaccccatgctgtcattggtggcttatctcatgccaatgcccaaactttttttatattagtcttatttttgtattaattgtgcatatttatggcatctcctggaatgtgacagctctacatcagctcttgttactgcagatgccctcgggtctatctacatagtcttcacctgccattttttggtctgctgtgattcccatataaccatgaaccaggaagttcactttgtacctttggccaacagagatcccatattaagactcccatattatattatgggggactgtattatccactcctatattaacgctattcatatacaataaaaacagagaaaaactttgaatatttaaagtgaggacttccttctgtatagccacactcaataaggtcatactgtggtttcaacaatgaggtgctgtgagatggagagtactaaacaataagaaagatgggatctttcttccttacgcatttttcttaaatattccaatattatctcacacctcaaatattacccagccctccaatattattccactcttgcatcgacagaggggtattctggccataggttttattatatgcaatgttatttatcactttttatttttacaatgttatatgtgacagaaaggaaaatttctttcacagcctttcttgcttaattgagacctccactacgtaaacactaaaatgaccaagaagaccaatcaggcgctaatgcaattaataaactgtgcttccttttaaaaaatgcttagattgcaagtccataatcccgtggctaacaattacattcaatcaataaattgctaattctacaggatgaacacaccttcattgaagctcggaagcttcaatggcatcagttggatgccccagggcaacaacatttacatgccataaaatatctgaaaatgatttaacaccatcactagtcaacaaaatcaaacatttgcctgaacatgtgaccaaatttttttctgatatgatatacatatacatacatacacacacacatacatataaaacaaacacacacacacacatatatatataacattcatatatattaaaaggtctttttttatataatctgttataggatgttctttcaatttatttattttgaacaacaaaataccgttcagagaagacatgaatagaattaaaactcttgatgagaatataaccttattatttgtcattagataccaccagaaatgcatgcaatacataagatacacttttaaaatatcactttatttatgttgtatttaagcccttattccaaatagaaatatattttaaatattcatgcttttgcactagatatttaatatcttaaaatttcccaccaaattctgattttgaaaatatttaaactgggaaaagataaatgaagattgaaatgggcttttatatacacatcacccaaatatttaccatttgctgacaagttttcatattgtagacatcatgacacttaatgtctcattagacattaatgtttattttgtctcatttaatctggaaagttagccacactttattttttataatgaccctattgcttttttttaagaatgcacaccaatgatttcacagaataagccacattttaatttttatattttatttatgaaactatttagaatatttttactaagaatatatagagattatggtgtgttttctttattgcatcagatcagagtcatataatgtcatttgtttaaaaagtttttattttgtcttcattttttccccaagttcttattgtgtaagaatacacataacataaaatttactgtctttaccattattaaatatacagttcagtggtattaagtatcttaatattgtgcaactatcaccatgattaatctccataactctttccatcttgcaaaactgaaactctctgcacattaaataataattcctcattaacccattaccccattaccccagtgcctaggccctggcaaccacagttctaccttatgtctttataatgttgactacactaaatacttcatatgagtgaaatcatccagtatatatcttttctgtgacttgcttatttcacttagcataatgtactcaagtttcattaatgtggtagcatatgtcagaatttctttcgtttttaagcctaaatgatataccattgtatgtatattccatttttcaattcaatcattcattagagttttctccacattttagtaactgtgaatgatgctatgaacatggtatacaaatgtcactatgaaatattactttcaaatattttcagtatataaccaggagaggaattgttggattatatggctagtatgttttaatttttttgaggaactgtcatactgctttctgcagtggctgtaccattttacattctcaatgtacacaaaacttctaatttctccacatacttaccaacacttgttgttttccattttttgatagtagtccatagtgtaatatggactatggtgttaatttagtgttgaacttcattcttttgcatgtatgacagttttcccagaacttggcactcttgttaaaaataatttgactacatatgtgaaggtttatttctggaatctctgttctattttattagtctatgtgcctgtatttatgaaagcaccatgctgttttgattaccatagctttgtagcaaattttgagtcaggaagttgtgtcctccaggtctgttctcctttttcagtaaagttttgctatttgtggttccttgaggctttaacttccctgatggtgttctttgaagcacaaaaggttctaattttgatgaagttcaatttgtcaatattttcttatttacttatttattgtccttctgctgttacagctaagaaaccactgcctaattccaggtcataaaagtttatctctgttttctcataagatttatatagttttaacactcagatttaggtctttgaatcatattgagttaattttttatagattgtgaagcagaggttcaaatttgttcttttgataatgaattattaagctgccctagcaccatttgttggaaagacaattattttcccattaaatcatttgacactcatgtcaaaaataaattgatcatagatgttgaatttatattccactttatctatctatctatctatctatctatctatctatctatctatctatctatctacatatgccatcaccacactcttttgataattgttgctttgtggtgagttttaaaattgggaactatgagacctttaagtttgttcttttttttcagtattgttttgtctattctgggtcctttgaattttcatatacattttagaatacatatgttcttttttgcaaaaagaaaaatcagttgaaaatttctaatggtcacattgaatttgtagagcaatttgagggtattgccatcttaacaacattgaaacatacatttcaagaacaagaagtatctttctatttatttaggtcctctttaatttttttctgagactatattatcatatttggtgaacaaatcttgcacttctttggttaaactatttcctagtattgattgtttttgatgctattgtaatgaaattaaatttcatttaaataattttaattttcagtgaagttttattttcattgcttatgtatagaaatacaactgatttttatattgattttttatcttgaagttttgctcaacttattagttcaaatgccttttaaaaattctttagagatttttacatctaaaagcatatcagctgagaataggtgtgctttcttcctttccaatctggacgtttttctccctttgcttttttctgttaaacctttttgcaaattaaaatttctattttgaggtaatttaagatttacatacatgtggaagaataatggagatcttgtggattcttatttatttatttatttatttattttgagacggagtctcgctctgtcgcccggctggagtgctgtggcgcgatcttggctcacttcaagctccacctcccgggttcaagccattctccttcctcagcctcccgagaagctgggaaaacaggctcccgccaccacgcagggctaattttttgtatttttagtagagatggggtttcaccgtgttagccaggatgatctctatctcctgacctcgtgatccgcctgcctcggcctcccaaagtgctgggattacaggcgtgagccaccacgcccagcagatcttgtggattcattactgagttccctccaatggcaatgtcttgcaaaactatagtatgatatcatagccatgatattgatattggtgatgtcaacacacagaatatggttctcaccatgagaatccctcattttgcccttttatagacctgcccactgccttcccaaacctatacccttcatagcccttagtaatcaataatctgtctttgatttgtataattcgttgattcaaaaatattatgtgagtggaatcatacagtttgttttcttttgcaattggctttttttctctcagcatacatctctggattttaatccacatggttgcatgtatcagtagttcattttttcttttcaatggtagagttgtaaaccttgctggaggtgtaccgcagtttgtttaaccattcattcatggaaagacatctaagctctttccagcttttggctattacaaataaaaattgggtgaatattcacgcataggattttgtgtcaacatatgttgtcctttctctagtataaatgatgagtagtccatttgctggatcatagtatagttgcacgtttaattttttaagaaactgctaagtattttgcataatgggtttaccattttacattcctaccaccgatatattagttatacaattgctccacatccttgtgggcatttactggtatcgctgtttttgttttcttattttagttattttgatagatgtgtacaatctctccttatgttttcacttatttatttatttatttgtttatttattttgaggcagggtttcactctgtcacccaggctggagtgcagtggtgcaatcacagatcactgcagcctcaaccgcccaggctcaagtgatcctcccacttcagcctcccaagtagttgagactaggtacaggccaccatgctcagctaatttttgtatttttgtattttttttaggtagacaaggttttgccatgttgtctaggtttgtctccaactcctgagctcaagcaatctgtccgactctgcctcccaaagtgctgcgattaccgatgttactccttgtgcttttaatatcaaatttcctaaaggctagtgatgttgaacttctttttgcatacttatttgccttctgtataacttatttgataaaatgtcttttcaggtcttttacccatttaagaaacactgaattatttattttttcactgttgagttttttgagttctaaatgtattctaaatactagtttattaattaatatattgcttaaaaatattttcttctgcctttaacttgaatttttattctctttacatggtgtggagtagaaagtttcaattttgatgaggttcaatttatcaattcttctttttatgggttataaaaatgcttttggtatcaagtcaaggaattctttgcctagctctagatcctgaaaattttctcatttttttgaaaagaaaattatagctcctcgttttgcatttaaatcaaagaccattttgagttaactttatataaaatattaagcataagctaagcttattttttctctctttttggcctatgggtgaccaatttctccagcaccatttattgcaaaggctagctttcttccattaaattgcatctgattgtgtataaaatcagttgtgacatatatatatatctccatctgtttctggtttctctattctacttgataaatctatgtatctatctctatgtcaacaccacagtcctgatcactgttattatacagttagtcctgaaactgagtagagatgtcccttcaccccatttttcccttccaaaattgttttagcaattctacttcctttgcctttacagaaaaagtttagaattatattgcttatatctactaaaaatcttgctgagattttgataggaattgtgatcaacttcttttcaatttggagaaaattggcaaatttaccacattgaatcttccataccatgaattaagatatgtttcttcagttatttaaatctgctttgattaatcttataattttaaaatattttactatatcaatcttgtacatgttttgagagacttacacctcagatttcattgttttcagtaattgtaaatagtaccgtactttctatttttgtgaacatgtgttcctggcaaatatatagaaaaagaattgatttcgtatgtttatactacttctttgaccttgctgaacccactgttatttatagaagtttatttgtagactcctaatgattttatacatagatcattaggtcatcagcaaaaataaatcaatttcatttttcctttgtgatctgaatgtttttattttcttttgtagccttattgtaccggctagaaacctcagtacgatgtggcataatagtggtaagagtgaatatccttttctcattacaaattttagagagaaagcacttagcagtttaccattaagtataatattagctaagtagaagatacttatgacttgagataatggcctttgctgttttcctcagagtttttacatgtaatgattgttgaactttgtcaaataatttgttggcattcattgacataatcatatggcttttcttctttaacatcttaatatggtgtatcattttgaatgatttccaatatcaaatcagctttgcatctctggaatcaacttatttggacatggtgtgtaattattttttaagttagtaaattctgtttgctaatattttgttacaaactttgcactttatattcatgacagatattagctttcttccttttcccccttttctatctctttctagttttgatatctaggtaattctagattcattaaaaaaactgggaaatgttttctcctctttgatttcttggaagagatcatgaggaattggtttttccttgaacaatcagcagaattatttaggaaaatcatttgggtttagagggcttttcattgttgtttttaaccacgaagtcaattttcttaataattaataggactattcagtttcctttatactggatgaagtgtaggaatttgtacttttctagggattggcccattttgtgtaacttgtcaaattttgtatgcagagccttttgtagtattgttttattatcattttagtgtctgtgtagtctgttgtgattttcctccttcattattgctattagtaacttgtgtctttccctctttgtcagtcttgaaagaaatttgcaaaatacattgatctttgcaaagaaccagccattttttattgattttctccatcattttttctattttcaatttcatttcttcctgttcttatctttattacttccatcattctgcttgtcttgggtttattttgctcctgtttttcaaggttttttagatgtgtgacaaaatgaatatttgttctaccctgaccaaattcgtatgttgaatccctaacttctagtgtgtgtgattgtatttggagatgggacttttaaaaatgtaattaaagttgaatgatatcataagggtggggtcccgatctgacagaactagtattcttataagaagagagacaaatgagctcgttctctctctacacacatgcaccaaagaaggccatgttaggtcatagtggcagagctcctatctgcaaaccaagaagagagccattaccagattctaaattgctgaaaacttggccttgaacttctagcgcctaaaattgtgaaaaaatacatttctgttgtttaagtcaaccagtctatgatattttgttatggcagccaaagcagactaataaaacctgtctacagtgttgttgagtgtgtctttgtatgacatgtttctttttttagtggttgctctatcttattgcagtctactggcatcaactttttaccagttcgtaagtagtttagaagccttgtttccctttatgcccctttaccctttaacatgtatcatataattatcataattattttctatacctacgttgagaaccacataggacagtgttataactttgcttcaactttcaaacataattctctcaagacaagaaaagtctattgtatttacctatatttttgtgaaatgtgattttttctcatgtttcaatatactttattattatttttatctgtttagagaactttctgtagtcattatttttaggtaaatctcctgtaattgaattttattctttattctttttttttttttttttttttgagacggagtctcctctgtcgcccaggctggagtgcagtggctcgatttcggctcactgcaagctcctcctcctgggttcacgccattctcctgcctcagcctcccgagtagctgggactacaggtgtccgccaccacgcctgaccaattatttttgtatttttagtagagacggggtttcaccgtgttagccaggatggtctcgattaactgacctcgtgatccacccaccttggtctctcaaagtgctgggattacaggtgtgagccacagcgcccggtcttgttctttattctttatctgagaatgtctttctcctccactttgagggatattttctctcaatataaaattctggcgtgacagtgctttttatctgtgtgtgtgtgtttgtatgtgtatgtgtgtgtgcatgtgcacatgtgctttctttcaatacatgaaaaatattgagacacttctttctggcttccttggtctctgatgaaacatccattgtcattcgaactgtttttcccctacagataatatgtcattttactctttcccttctttcaatattttttcttagtgtttagttttcagaagtttgattatcatgtgctttggtgtaaatgtctttgacttcatcctgtttgcagcttgttaaactttctgaatttctagacatctttttccacaaatttgggagactttctgtcatctatttttttgaataatgttttcagccttgttcatttttttttcttcctgaaaatccagggacaaaaattttagttttattgtttaatactatagcttttgatgccctgttaatctgtgtgtattttccctgtagctatcgttgttcctcttgtctcattttatctcttttgttctgtttggataattttaatattcctattttcaaattaactctttcttttcctccattcagcagttctgtctatcaactgtgtactttattttgcttattgtaattttctgttctacaatttcatgttcctctttttcttctatttcttttttgagactccatatttgctgaatctttctactttttcagtgtttaaacatgtttgtaattgctcactgtagcacttttataataaatgttttaaaatttttacaaaaaattttaacatctgtgctatcttggtgggaatttattgattttgtttttcgttagtttgagttttcctggttctcggtatgataagtaattttatagaaacttgagcattttgaacatgactctatgttttagcccttctgttttattctcctgactcctgatgatccattattactgccctatcagggcccctcacttggcatgtattgacacccacaaaacatctcataaatgctgagtaatggtgggtgttctggctctcttctaagcctcctgtgatatatctggttgggattatcttagtactcttccttatttttaatccacagactgaatggaagtgtgagtgatcaatactactgggctgtggtgaaagtcctgatactctacaatgtttcctctgacaccatccaaaagaggaagacatgagaagggaacctgagaacactgcttaggtagcaatctgtattcctcgctgtggtcactgcttttccagaggggtatgggtttgcctggctattgcctggtagggatgtaaggtctggacttataactatatttctttgataccaccttagtaagagttctggggtgtctaattttggcctgaagagcatgaaatcttaaatttcctactaggtctgttgtggtatgggtacaaatagggggacttatattttttctgaaatatttgtctgtatagtgcaattattgtctaaaggttttgtctgtaccctttggtatttccagttgtcagtttctttggctctaaattcatgatatagaaagaaaaacaaacaaaaagaaaaacaaggatctcactatcctgtagttccttgggtccagaggtctctatttagtcctgttttttctctgcctttcagagtcttcttataattttcatatgtattgcctaaggtttttatttgtacttagcagaaagagtagggaaaatacaactactgcaactttctagaagtcttataaaatctttttaagcataaaaaccgtaaagtcatatatacttgtgtgtccattaatctatattatctgtattttgtacatgtatagagaggtttctaacaatatttgaaaaatttaactatatctgctgttttaagtaccaactcgttatttcatccactcaaagttaaacttttaatcatgtatgtgttattctgttctctgtcatctgcaaatttggtattttccatagattgattaaaattattgataaaatgttgataaaacagaagataggactccagataaagctatgacatactgtattttatcaattacttatttatatgtacatccagcaactgctttttcaatgttttttcatgaccagtgattgtattaattaatggccataaaaatctaaaaagcaaacaaaaacacaaaaacaaaaatacaaacaaacaaaaaatgaaaaccaccttctattccccgaagtttatacatctggtaagtgaagtagagagatgctcatgcatgcacactcatattcacaaacacattttagaaaatccagagtctataaaataaattatatatattatatatatgattatatataatgtataatatatacatatatcatatataaatatgatatatatatatatatagtggtggcatatgtgtaaaaggtactaagtattcctaaggcagagaagatggcagtacacacattttactgactgataaacagatactaggccttgtggtaacaggataaacttctaagtgtaaatgtataaaagaagcttctgatttctgagaactttaatactagtgatactattaggaaaactgttagtctcagctggatgagaaggtataatgaatattactagtgtgattttttactaggattgaaagctgacttatacaggtgggtgttattgtcattccatttacgtttagtgagatgaaatagcattttacatgattgcccagttaagaatttgttgaactggattcaaacccagggctgtctcactccaaagtacaagtttttgattactatattatattgtcttctcaatatataacaggtatttatgggtcaacataatgtgatatacatgcacagatctcttttgtttgggaggagttagtgtgttggtgtctgggcatatcaaaaagaggggatagattgcatatattttcatcaatatttcctcaatattgttcctccaaactgagattttgataaatatttagagattaaaataaatgcaaaattatactccctgacaatactctgcttgaaaattattaaaaggcactcatcagacacatgttgagctgacaaggtattaatacccttccatgaaagctgaacagcgtaaaaggcatctgaattgtagaacattcaacctatattcagacataagccttgggaggggcctcaggcagagcagccaaaattaacttcagataatggttttcaattcactttactgcacagttgacttgagaattaagctcacaatgttctgtttcacatattatggctgaatttgttttaccttgagcatttctgaatgcaggtataaattgatgcctgcctaaaccaatgtaaagatcttagtaaatcccatagataaattcaagggaaaaaaagttactacgagtgtcaaatgccagaaaaaaatttaaataaaatcaggattgaagagtgctgaatgaacttggtggtagaatcatcaaaagcattattcagtaaactttcagtgaagagttagatacaagagtaagactggaatgggtaaataagtgaatgcaaggtaaacatatggactgagacatattgccataactctacagctctttttcttttcatagtcaaactttttaaagcttttaaagtctttttaagttgataaaaaatgtaaagacgtttatgtgctcaaagaaaggtgaagatgcacagtagtgaggctagaaggttcaggcacatcttttactaaaacaatggtgacagtcaaactccacagcacagaaacattaatttgctttgcataggaaaaagtttatttctttggagaagaagtcaggtggatacataattctcaacttcaggcatcccactttcccattgtcatgctcttgtgtaatctcttcctttcaagggaaagtttaaccaagtgaatatctgataatgtataaaatatgcaacacagaggatatgtcaattatatcagcattctattgctctctctctgcttctgagagaagtaagttgccttgatgtagctaccccatggagaagttcatgtgacaatcaactgttatctcagatcaaaagtcagcaaagacctgagtcctctaacattcaggaaggagcctggaagcaggtcctttcccagtcaaacttcgtgatgactgccgccacagctgacaactcaatggcatccttataacagaccttgagctagagtctccctgtcaagctgcaccagatttctgatccacagtgagagaggtggagataaagtatacaggttgttagaaatgtcacatattttagttgactatgtctgaatttcattgtaatagtttatcataaagataaaaaacattttataaaatataaactggggaagatattttcagactgtactcctctaaggccttttgagtggttccggggagcaagtgaatcagcaccatggagagctccatgaacatgcagctgtaacattcacttagtgtcactatttatgtctccttgtttttagctctgttataaaatgtccatcttattgatacatattctccacccttttcactaaagtctttaacgtatttttaatagttaaaataaattttctgtctgatagttccagtagctagggcataattgagtctggttttgttgattactttctttattgagagtgcttgctgtccttgtttctttgtgtgtgtgtggttttttttaatgattttggattgaaagctggtatctcatgttagccaacagagactaaattaaataatatcaatgcctgcacatggacacatttcttttgcttctaggccttcagtgtgggatgttgatacaaaatttacatggagtagagagggtccttattcctcttggatccaatactttgaagggttatgtaatactgcatctctgggtcttctttacccacatacagaaactaactgagaatgaaatcacaagaggaaagtagcaccaaagagaagaggctgaaaaagacacctctttatattttgaacaagaaaaccttttaacctgtaagaaaataacttttgctggcttctcagaaaattgaggtaaaagaacaactcactagtctgaagcctaaggaaagacacacaattctaaagaggttcaggtcttaagcacttgaaacttgcagtggatgtcatttgatgtacaaactcttaagaagaactacagtaatattttcaataaattattaaaatgcgtgtaggccattgtggggatacataaacattggaggctacagacccaagagccattagcacttataggctcttcttcatgaatccaattgaatgcttatgagaaggactgaagtcaggatgagagaccagagaaagaattctttgtgcaaatttggaaaagaagagctctatgctcctccccctttcatattatgtgggaaagtgacaccacctcagaatgatccttgatcatttcctccctatgagaaaagacatgaagacattgggacaagaggagtaaaccctgttgcgtttggagcacaggtaaagatccattgcagctaggggaagggaagagaaggcatcttactctacacctgagtgatgggtaggaacagtacacagatatgccctataactagcatggagacagcatcactgagaagatacctaagtctgatgctaaaccaagacaactgaaaattaccccaccctccccatccaaaagctggcatgcactgagtaacaaacaacagcaatccattgttggggaggctcaagagcacgagagacacattttctgaggcacaagcacagataaaacacctaaaactgagggtggagcaaaattcagtaaaaccatgagaagaattaactcccacattaagaacaagataattatggaggaatctgaagcccatggtatgtgagcatagccataacaacaacacaaccaacccagataactcctaaataggttgactcaacatcccacaacaaaggcttagaagaaaaagaaatgtgcctattggcagacattgatatgatttaacacagtctctgttggcttacgtgagatatctagcttttaatcctaagtcattaaaaaaaaccacaaagaaacaagaatagtaagcactctcaataaagaaagtaaccaacgaaaccagacaaatatgccctagttgttggaactatcagagagaaaatgttttacaactatgaaaaatacattaagaactctagtgaaaaaggtgaagaatatgcacaaataagatgggaatttttttaaagagatgaaaacaaggagacagaaatggtagcactaagggaatgctgtctctgctttgtcacggagctctccatggtgctgatgcacttgctccactagaaccacaaaaaaggcctttgagaagtatagtctgaaaatatcttcccccatttatatttgatcaagggtcattttttatctttataataaaatgttactataaaatttaaacatagtcaactaaaatatgagacatttctaacaagctgtctgctttatctacacctctgactgcatatagtgaactttgggcagtggagcttttattgagtttccctcaattaacacatgtctcagagtgaatatattttttaagctgcctataaaattttctgtccttttagttttggtactaaagtctgagagggttttggaaaacaaagcagaattgtgaaagttttactgagatttgatacaaaatttatatggagtagagagggtcctcattcttctgggatcactagttagatgggttgtgtaatgctgcatctctgagccttctttatccacacatgggaagtaaccgagagtgagatccccagagtaaactagcaccaagtagaagaagaggttaaaaaggagaaccctttatattttgttgcaagtctttattttttggctcaccagaaacctgctaaaagcctggattagaatatagtttttaagtaatcatgaaacttcaaataagattacagaaaatgtagggaatattttaaaatcttgagaaatttttagccaaacagaaaatccagaatccatagaacaggaagactaacacattttactaattaaaaatatattaatttaaaaatacaacagaaaacaatgaagaaaaatacaatatgggtaaaagtatggaccacaaatgcaacaagtatttcattttcaaaataagtaaaattcctaacagatcactaataatgaaaaagacaaccctaaaactggtaaaataaacaaaaatgtatttcattaaaaatataaaacaattagcaagtgaaaatgtattgtgaaatttactacctcagtaatatagaaagtgaaaactaaaattaataatttttccttgtagtgcaaattggccaacataaaatgtatagcatttattatgcacatactttaatcccaaattctctttttggcatttatttttaataatttttacacatttacacaaaacatacatgaccaagaaatttatgaaatgtttataatagaagatatcaggaacatttaaatattttttaattggtgaacattaaattaaatatattgtttttatattaagaattctatgcaagagttgaaagaattaagcatacttgcatgaactattctgcaaagtttcaagtttccaacttaaatgaaaaacaagatgcaaaacaacacattgttctctatgattttgtgttaaacacacatctaagaaaccttatatttctacatatacatatattgcagggcaatgaaaaagtgcaaggaatataaacactctattgatcataggagctacacctagagtaaaaatttaagatttgtattcagcctttaatttttttcacggtgcataatgtgcttttgtaactacataaatgtactaatctgtattcatactgcaataaagaactgctcgagaccaggtaatttagaaagaaaataggtttagttgactcacagttcagcatggctggggaggcctcaggaaacttacaatcatggtggaaggcaaaagggaagcaaggcaccttcctcacaaggcagcaggagggagaagtcctgagcaaagatggaagagcccctcattaaaccatcagatctcatgtgaactcactcactattatgagaacagcatgtggaaagcaccccatgattcaattaccgacatctgatctctcccttgacatgtgaggattacaatttaagatgagatttgggaggggacagaaagcctaatcatatcaataaagatattttattatttattaaaaaggaagccaagttttgtcacacccaaacctcttggaaaatagtaagtttacttttgaataggtttttatgttattttccttgaaaatgcttgaagaatcacaaatggtttgttcacaaagcaactttataatagtcacaatgtaaattcattaacgaaagcaaataaataaaagaatgggagaaggaaagggaggaagggaagcatgaagaatgtagtaaatagatgtctcctgaaataaaaaattttctcaatttctacttcaggtattttacttgcaaatgggtgcccttggacaatttatctaaattcttcacttattagaaaacttccctatattatgggaatgttataaatatttaaatatggttgatgtaaaattaccaatgtaaaattacaaaattatagtagatacatgtaaccattaataacaagatgcatcaaaaacttatttttctattctataattgtctttttttttttgagacagggtctcagtctgtcacccaggctagagtgcagtggtgcaatcatagctcactgcactctagcagctcacatagctcacatagcctcaaactcctgggctcaagtgatccccccacctcagcttcccaagtagctgggaccagaggcatgcaccaccacgtcttgctaatttttttttttttttatttgagacaggtttttcctgtgttgcccaggctcctgagctcaaatgatcctcctatctctttctcccaataaactcccaagttgatattatttctgcaattattttaaaagatcaaaaataaagaggaaaagttaattttcccctttcagtctcactcatctataattttttgaaagataattgtcatttacacctttcttatgaatataatataagggccaaaggaaaacttcctcgttgccctctgaagggtcactgaaccactgacaaaaggcagattaataatagaacatgcatagaaatacattaagatgcatggcagagactcacagagtgattacccgaagcacccgtgaagttcagaagcttatagaccatcttctggttacatgatcagtggtggctcagagcatggcccaaaacaggttatggcaataagttgggttatgggagggagagaagagcagtcctgactagccaaggtggtcttgttaagcagatgaaggctcgcaggcagaagccctctgagagaataagatgggaaatgtttcttccagactttaaatatgtcagattttcagttaatatttcctaggtcagataaaggtgggcctcagagaaaacctgacggcatcaatgcagatttcccctgcagatgcaaatctcatcctgcaagacagctttttggctatctttttattccaagcccttgtaagtagtcaccttgaactatgccaggaaaatatattttggggtgaaataatttggcttccttcaacaggctaccttgtatgttttttaaactaatagttgagcctccaaaataacacttttaaggccttcagaattacaagacaacaataacaaaaaaactttttttttttttggcctaaccctgtataataaatatttctatattcccagtgtcattttttttttcttttttgagtcagtgtatcactctgacaccgaggctggagtgcagtgatgcaatcatggcttattgcagcctcaatctcctgacctcaagcaatcctccctttttggcctctcaaagtactgggattacagtgatcctccaagtttgtttcaaatatttgactacagattttttaatcttacatgataagtagacaatttagtgatttacaaaaagagactagaaaaaaaggagctgtagactgaattgccaactatttcaaaaatataatctttgaagacctaagccagtgattctcaaactgtagttaagtaatcaactacttaaaatgcatatatccctgaaccctcaaggaccacttaacaatgtgtatatcccttaactcacctcatggatttgaattcagtagatcttgattatttttaggaatatgtattcttacatataaccgaaagaaatttgagctgatcactctcagtttgcactttaaaacattgcattaaattccccctccctccctccatttttagccccatgaagtaagcttcacctcatgagtcaatggagtcattatatcttcataagtttgtaagtcagtcattcaccgacttatgttttgagaagatggagacccatgatatacaacttaactgtggcagttacataaaaattcaacatatacatgtataaagaattataacacatagcaattatttactcaagcaagatgcagagacatttgttttgatagatgagctttctcagtagctttttctacttggcaagccaggtgtatttttagtagagccaaagcacctggtttagcagaacatccattattaatctgatagtagaatgtataatttactgcccataatgctaattataatagctccttacataagcaaagctgaaggactgccacttaaattgttgacagtagctagtagattacagacttaaaaaaattccacagaaacataaaaatatctggtaaacacaaaaatgaaattagaatggggttatataatttaaatttttaatttagaggactctctttaaaggcaaataatatatgcattattttatgaagatgcataataaatatgccacattcagagaatggtttaatcaaatatttttatgctaatagaaaattaaaggataaagccctacatactgtcaaattatgcccccagttgacaggcaagatggactccctgtggctcaaaagtaagagcagagccaagaggccatggcgggccgaggaatggtcaagttctgtgtgtcctacaaagtgttgtaaaacttgtttttctgccaccaagtcaaataaccatttctggaaacaactgcagctggaaatttccctagtgatcaccagcagaccacctggtgccaactgacagaccacctggaaccagccaactaagaaagagactggcgatttggggcttaatggtcgtccagtcacaactctgtccctcactcccctgaatcccctcccttgccttccggtttttgctttaatcatctctcactctccatcctgctccttggagtacactcacttttgtaaaacagaggctatgtctccctaatctgcagctttttttttaatagaaaatagaggtctccctttatgctctgcagatcacatggtctgttgttaacaaaaccaaagattaccttgtgtagaacagagtatacattttacctattatagaataaaattttgaacaatattgagttataagtgtataatatcagtacattgggatattcgtgacatagaacaatattgaatgaaagtactaagaaaacaagaaagaaataaaaagcttcagtggtgatataagacatgttgatacagaatgagggcatagtgtgtattaaagtaatgtcacagaggccttgcgtagaaaaaaaggtctgcttctgtatacaaaatgggattaagatgcatggcagatatattttacttcatagttctgcttagtgtcacacatagagatacatgcccttatgttaactcaaacactcaccgaaatggtaacatgaaaaatcatagttaaagcattttcaacaaaaaattaaagtgtttggtctaattcatctcaaaggatttattcagctttaaaaggtttaacattccctataatattaacggcaaattaatcaattttggctttgtaaacacaatacaaaattatttgaatatatgttttattgatataatggccaagtttttaaaatttatcttaataccatattaaactccatgaagtgaaagatattcaattgattgtttctgaaatattgactcacttgagtattctaaatcaactatatttcataatacaccttcatattaaacaatacgttctcaaaggaaatgcatttattagaagcaaactgttgaaatataatatagatggtataaattatcatccaaagttaacaataattgtgtcaaggctaaactgatatgtacatttgatcttctgacaaataaaaagatcttgccaaaaatattatcactgaagtatgatataccatttttaagacatactaatttaactttaataagtctatcagaaaaacgggtacagatattatcacaactgctaacatcacaaaaaagagaaaatcagaaacgatatgccatctgatggaggaacataatatgctttgtgaataactgccaatccaaatgttaagcctgaatctgataaaaactttcagattcaactacccatttacagaaattcagatatcagagaaatgtgctaaccaatagtatgaagatttaatcaacaaaatccagaatataaaagaatttgctttgtcaacaaataaattgcaagataaaaagcaagagatggaaaaacttgccgatgagatactgtgtgtgcatgttcctgtttatgtgtatgtttgtgtgcacatgtgtgtgcaacaaccaattacaatagattttatttatgtggattttaactcaaacaaacagatgaaaataatggaaccttccatagaactagaaatgtatgaacaataactacatatttaatgatatatgttagtttttaatgtgaatgtgataatggcattgtagattttttaagaaatctatttttgtaagataggaattctattcatatcacttagaaatacatatcaaaatttttacagaaaaactatatattttctggaagtacgtaaggtttagataatacatctttagacatgaattgatgcttaccaatgcataggataattacgcagcaattatatttgttttcttttgcatgtgtttgaattttccacaataaaaagttaaagttattttaaagcatgtatttataaacaaatcatcatggagaactttttgaatgttttataattttacaaagtagtttcattgtttttattattcaaagtagattaacttgtgttgttacttttcataggtaaaactttttattctttcacatgtgtaattaaatatttccactggttagagtgactgaagttgttacaaatgattgcattttattatctactaactactttcactattagcattactattctgattaaaggatttatacatattaacatgataaagagataagataaatgtggattctgtaagaataatttatttcttcagtcttcttatctcaaatttccatatccaaaattatgagttttttgttctcacaaaataaaatgcattacatatttgaagtgacagcagtgtcaacttatcaattccaatggtgttcataataagaaaggagtatatcagtgaaacatctatttgaagatataaggaaagtgaattccaggcagataagagagtaaatataaaagttaaaatcctgagttcaaaacaagattaaactgcttaatgaagtgaaataaattcagttgttctgaaacggagtaagctgagggaagagtgggttgaaataagttttgtttgagcaagccagaaattataattcatggtaaggaataaccaaatggtgagagcttgttgaggaatagagagacatgatctggctgctggtgagaaacgaacttcagaaagtgaagtttaggaagtcttcaggaagtgaagtgaatgtttgaggaaagtgaaacaaggcaaaccgcagtcaatcaatataaagatccttgaaattgtccaggaaaagactgtattggcatagggaggaaaaatgatcagatatgtacttagaaaatatagtagaaatgctttgagattagaggaaagggaagaggagacagctacaggttttcttctcaccgcctctcacccaagcagttgtaagaatagttttgccatttatcaagatggagaagcagggaggagaccagatgtagggtctaagttgtttgtttttttccttttctttttttctccctctttttcttcctttcttttttctattctttctctttttattttaaatgaattttgaaatctgtattttatattcagttgaagatgttaagtacacagttgtgcatatgagtctgaaaagctcatgagaaagaatgttctagagctatacatttgataccattataaagctgaatttttaaagctgtcaaactagatagagttattgatgcagtgtacataggacagaaaagaaggtcaaaaagtaattcatggaacaacttgccatttaaatgttgagaagacagtgaaaattttgaaaaatgagtgtatattttcatgtcaccactttaccatgagattaagtattaattagtttttgcactgtaaagttggctaaaatgcattacgtttgagaagaatgcattaatgaactatttttatacatgctgtcattcctgagaagaaccttttagagtaaacctttttgaatgtttaggagccctactatttctgactgtgatgctttagttacctcttaaaatacaatatgtaaagaaacttacacagcatatacattgatagctttcagacagtaggtatctggcaatgctggatagtgatacctaaaagacagaaagtaaagaatataagacggattaatgtctccacttactctctggagagagtgtctaggacacagccaatagagttggcaggttgaaggcagaggggcagagaaaaaaaactgaagaaataataacataatttttctaaatgttatgaaaattataagcccctagaactaagaatctcaacaaactccaagcacaagaaacatgaagaaaattaataaaagtatatcatcatgaaattgttcaaaggggaaaaaagacatgttatggatagaagaataaatataaggatgacaacaggtaaaacaaaatacaatagagcagcatttcgttgaatttaagaaattgccaacaatctttcaaaaacaaaagtgaaaataaagattatcccagacacagagaaaccacaagtatttatcatcaataggtctacactaaaaatatgttaggaaaagtctttccggaagaataaaatgatatgagattgaaatctgtatgtctaaaaggaagtaaagtacatttgaaatgttgtataagtgaataaatataatttttctataattttaaatttatttaaaacataacaccaatatgttgtggtgcttataccatatgtaaaaacaaatgtataaaaataataacacaatgtctagaaaagtaggtgtaaaaatttttattttaaaggttttttaagatttaagcattacaacagtatctgaaggtatgctgtgataagtaaaggccgatactagaaaatctaaagcaatttctctctcatatttctctctctcccccacttctctttctctctctctctctcatgcatgcaccacacacacacacacacacgagagagagagaaagatatatctaataagccaacagagcagataatacagaatcattttaaaaggcagaaaaaaagtaaaaagaagaaaaaactaagaaaaaatggataagaagaaaatacagcaacatggtagacacaaactctaaattatcaataatcaaattaacagcaaacaggataagcattccaattaaaaaccaaaactagttaatggaatggctatattgatataaaacgctggagattccagaggaaaaaggaatcgcaaattgcgcgaagagttatttagtaatgacaagtgagtaattcatcagagataacaattataaatgtctatgaacctaaaaacagaacttcagttacatgaagaaaacactgatagaactgaaaagagaaagagaaaaaaccacaagtaaattatttttcaaaaaactgacagttctaagcagagcaataacaagaaaacgaaataaatacaaaatgaaataaaacatatatgggttggaaaataagaaataaaggttccttgttgcagataatacgattgtctagtcagaaaactccaaggacatagaaacaacgagaaccaatcagggagtttatcagggttttgtaggacacaaagtcaaaatacaaatcaatcttactttgtatactagcaataaacagttagaaattaaataagaaaccacttagaaattaaataagaaaccactaaataataccacttagaacgccacaaataaataagttgatgttacttcaacaaaatatttacataacttatatgccaaaaattttttaattatgctgataaaaaatcatagacctaaaccattgaagacaaatatcgtgtctgtggaacagaagacaacgtaataaagatgtcaattttcctccaatgcaatttgtatcaaattcaggttgatattggtaaatatttatattgtatttctaaaatatataagaaaatacacaaaaaaaatagccaggcgcggtggctcacgcctgtgatcccagcactttggaaggctgaggtgggcagatcacctgaggtcaggagttcaagactagcctggccaatatggtgaaaccccacctctactaaaaataccaaaattatccagaagtagtgacacatgcctgtattctcagctactcgggaggctgaggcaggagaatcacttgaacccgggaggcggaagttgcagtgagccaagatcgcgctattgcactccagcctgggcgacagagggagactccatctcaaaaaaaaaaaaaaagttgaattattaaaatcatgtaaaaaataagagaaggttgggggattcatgcagcccaattataactcattatatagctacagtaaccaaaactgtatggaaggatagacatataactcagagaacacgatccagatacagactcacaaaaatatgcccaaatgattcttataaaggtgcaaaagcaatttaatggagaaagaggagtcttttcaaccaatggcattgacaatatgaaattttttttaaaaaaagaaccataacttaaacctcacactttatttaaaaaaaatttactccaaatagatctaaatgtaaaccataagctatacaacataagataaaagttttgtgaatttgggctagaaaaaatgttcctagacatgaccccgaaggcacaatctataacagacaatatcaaactgcaagtaaggacatgaaaagatgttcaatattattagccgttaggacatggaaattaaaatcaagatgagataccatcactgctatgttttgaatgtgtcccccaaagttcatgtgttggaaatttaacacccaatgcaacaatattgagaggagaggcctttaacaggtgattaggttatgagggctctgctttcattaatggagtaagggtgttctcactggagttgattagttttcttgagagtgaatttgttataaaagcaactctggctcctcctgcacgtgctcactcccttgcccttttgtctactgccttctgccatgggatgatgcagcgaggaggcccgcaccaggtgtgggccctttgatcttgggcttcccagcctctaaaaccaaaaaaacataaatctctgttctttctaaattaccctgtagcaggatttctggtatagaaggacacaacaggttaagacaatcttaggtatcttaaaattactaaaataaaaaaaaaaatatattgacaacactggtggtgaggctggggaacaactgggggttttataaattgattgtgaaaatataaaaggggatagtcactttattagttttctattgttactgtttaccacaaacttagcagtttaaaacaaaacagtccattttctccatttccttgtgtcaggagtctggtagtagatgcagcctgcctgactgctgttaccaatgaccagagttggggcaaacttcacaggttaatagcacagtccttcataagattgttctcacttcagacaacagtttctcttttggaaattccaagactaccctcacttttgtccagttggctacaatttctgagattgttactacactaccccccttcaggttcaataattttgtagagggactcatagaactcaggaatatcctataaatatgattactcttttataatagcaaaaggatgcaaatcagaactgaccaaatggaaagacacttggggtggggtctgggagggtttctttctttcttctttttttttttttctttttttgctatacatagattcaagtttattaattttaaattcttaaaattaaatttttgattgatttattttttaatttttattttaagttctggagtacaagtacaggttagttacataggtaagctgtgtcattggagtttgttgtacagattatttcatcacccaagtattaagcctagtaccatcagttgcttttcttaatcctctctgagagggtttcaaatgtgaaactttcattatcctctcccatgtaatcagggtgcattaccctccaggcatactgatgtgttaccataatcagattacagccaatcagggaagctcgcccagtgctggtgtccagaattttaagtatgacttcattacctatgcatgattgagtcattggccatatgactcagtcttcagcccttctcccatcccaagcagtcaggctcaaagccccaaccctcttatcacatggttgttctttctagcttgaccagatcccatcctgagtcatctccttaacacaaactaatctaggagcccaccatgagtcaccttgtcagtataaactttcaagtgtgagccgaagggtcaccatgaataacgaagacccttctatcacttggcaaaacccaaagatttagaggctacctacctctcagaatctgataataaaagccagacaaatactgtttattgtacaagtcctcttctcagagtctcacatggttaaaattaaggtgttgggtagctgtgtcttcattgggtggctggattaatagagcttattttaagaagactcaggttgttggaagaactcatttctttgtggttatgtaattgaggtcctaattttcttgctagttattggctaaaggccactctcagcatctagtggttactcttgggtcctttccacatgacccatgccatttaatatgctccgtcaagtccagaaagaaagtctatgtgtatttgagtctgttttaatgggctcaagggactacgtaaggttcacttatggtaacctcccttttgattcattcatagtcaactgactaggaacattaattacatcttaaaagtttctttggccgtatcacaggagtggtttttatattcacaaattctactggcattcaaggagaagattttatagggggcaggtacactagtgggtgggaatcatggaatccatcttagaattctgcctattatttccactctggtaaacaaattgtcagttttttataaaattagatacagcaagtgcactcctgaacatttatcctggaggaattaaaacttatgttcatagaaaatcctgtacatgattgtttataccagctttgtttgtagtaactggaaagaaaactcgaaacaaccaaaatgttaatctttaattaacttaccaaagagaaaaaaatccatagagactagggatagcaaagaagggtttctaaaagagtaaacttcacaagaaaagactcttaaatgaaacaggacagtggagagagaggtgctgtggttaataggaattcaaaaaagatcaatggggtcaacttccgaaaacaatgattatatagtgtagcatgaaatgaaaggcagggatataggcgaaattatggaatgtcatagagaccacattaaataattaggagaaatctatgaggttaattatgtataaggtctgtgttagtctgaacttgcctcactttaaagacatacttgagcctgggtaatttataaagaaaagaggtttaattagctcatggctctgcaggctgtacgagaagcaggcactagcatctgcttctggtgagggccttaggaagcttacaatcatggtggaaggtaaaggaagagcagacatgtcacatggggagtgtgggagcaagagtgaggaggacactgctctaaacaaagagttcttgagtgagctcagagtgaaagctcactcattatgtgaggatattaccatgccattcatcatgagggatccacccccattacccaaacacttcccaccaggctgcaacctccaacactggggatcatatgtcaacatgagatttgaggggacaaatatccaaaccatatcaaggttccagaaagaaaagagtaaacaagtttaaattactagctttggttaataacttagtgaaaatacaccttctttcaacaccacaaaacccatacttgacatataatgagacaaataacagtataattttacaaaatgaaagttcaagttcttgcaacacatacttgtatttatttaataaagtctatcaaaagtatctacaaagtaaacaaagtgccctaagatcaaatgtagctaattatttgtagttactatgtagtaactaaatgtagtaactaagctattatttattcattattatctaatttgctcccagttgaattttcaacatcacttggtaacttaaaccttggcacttctagtaatcttgaaatatctcagagttaatgagtcatgcatatgtgtgtcatgtgcattacaataaaataaatacccccacagatcgttacaatttataaagaaaatgagaaggaagaaggacaggaacgaagagaggaaggtaaagaaggatattaaagtgagcaagacttgaaacaggaacctgctaacaagagtgccaggtgggtttttcaggcttaacattgttagaacattatatatgaatgactttatttcatcaattatgcacataccatacatggacacactctcacatttccaaaattagaacccattttgcaatcacacttagctagggcagtgccatgaggatgtcatttcctttacatgtactagcttagtttgaaatttttctgttgatggtaatagcatgcagaaaatcagatattacgaaatgaatgtcagtagcctgaagaatttctagagaaaatgatggaatactctttcagaaatgatgcattgccacagctcttcgaagcacagggaaaaataacgtatggaaaaacacagatatagacaggccagaatcaatatctgattccgaatctgcagggtgtgactatggagaccgttaggcataacttaactaatatttttctcttgtactttttaaaataagcacagagtcacatatgatcatacttttaagtttaaaaacctttttcaaaaagtatgaacataaaagttataaaacatgttgtgtagtcattgagttgtcaatgtttctgaattgtttttgtggcacattggattcatatggtgcacattatattttatggcatttctggttgaatgaaaatagcattgagcatgtctttaccatttgcagtctctgaaaggagcaaaatggaaaactatcacatactgaatgtctaaatctttgttagatatcaagctattaagtaaaacatcttctatcctcccattaataaatatgtcttcatttttatctagaaggcttgctgcccatcccacttttctttccatctgcaggaacctccagcacggtgaaggaatttccatgcatgcactctagcccacttactcaaactctgcctgctgtgtagaccctacacaactatgaacagctccccttttaatggccctctaaaatagtgttgggtctgcagggatgatctgacttctagaggactgactggcaaagaacctggcacaggccctggatcaactgtcaggcttattttgggcagagagtatctggagtatgtctccaatggggagagtggttgcaccctggattggacactcttcagcagctagaatgagcccctcaaatatgctaggcccctgtcagaaactctcagctctccttgctagtgtcaaagggtggtgctgtaagttataatgctttaaaaccaaattggctcctaagaaatatgtcattagattatcaagttgttgataaaatactggtggtaacatttattaagctcggaacataaacttatgaatcttatttttacagctttttccttccttccatttattgtgtaggcagtctcttcttgccatcatattttaagtaacaaattggaatacactatttattgactcagatgttctcagtgagtgctacagctattcccacaaaagcacgttttccagagaatctatgttaattctttatacacctcagatatttagatagtccagcaaaataaccacatcaaacgatcccatgactgatggatgaatttaaattataagattgctttcataactactgaattcttctatctggatatgaaaatagatattttctataaatcagagttagtatacatttcttagccaaatggctttccatttgttctgtgtcatctacaaataacatgttatcaaaaatctcactctactgaaatgaaagttttatgtctttagagagaattttttaaaaaatatcagtcaaagtacaaactccatgttaaaataaaatgttgttgaacaacaaatatttcttattataatagtaatttgaatgccttttattttcttcattgtgtgcgttctaagaaaagataacactcagctgcacatagatggctctttcattttatcaagcttagagattccatcttctaaaatgcctccctagttccattactttaattaaaatgttttgatatgttgctgtaccttggacagtgctctttacttgccttaaatccttacattgatatcttggtgttttctctaatgagtcaccttcaatgttaaattgaagtaatgaagaaaaatagaatgaattagagatcaaggaaaatgcttcagaaggtgagttcactcaggagatcttgtcattaacattacttttattgagttgaaggaaaaataatttaatactggaatacacaaatagcttgtttgtgatgctatatttctatgtcccacagtgctaattggctgcccattgagccaaagaaagtgccataagaagatctaatatgtctactaatattccactaacagcattttaaagccagtatgtatttatgtactcatactgcttagcagtaactgtagttatgtgatagaagatcggtgagagaaaaaatgggcaaagcgggggtcaatataatgatctgattttcacatggtcttactctctggtcaccaactaggcaactttaaataatatcacttttatattgccagggtattatttagtgcagttaagagcaacttaattacaacactgagtccaccccaggaatgggaatgtgtttaatgtcaaagccccattagaagttcacactattttctattccttagttctcatagagtaaagccctaaatttaatgtaaccccatttagctgaaagagttaagaaagcatcatgctgccctgaaaatcaccatttaggaacaaaatgaagaaagaattgagtttcacatggaaacacctattgtagaaatgataaacagatcaaaggactgttatgatttaatcacgaatcttccatcctagtttattttcacagaagaggttttatacatctggctgataaaatttccatatataaggcataggtttttcaggaagacatgagaatgttgaaacaactaccagggaaagtgtgtgaaacagagtctgtaattaatatgtctacaaccaaatggctgagcaacaagcaagagactctcagagttaatggtggagaaatcagtcaataattatttctagtttgactccaggccaatacacagaaatagttttactaaaaaaaaaaaaaaaatgtaatgggagcattacatgtaaaaggagcacttgagcaagctccaggaaaataaaaactttgctgctagatgtgaaattactgatgcagacagagagaaactctttaatgttactctcttttcatgataaatagttcgaaatgcaggcagagtagcttgcagaacaatggaacgaagcatctccttgtgtgcttgcaagcaactaaagaaatgagttatgtgaaactaatgtaaagatacaatccacaatacttgagaaggttttggcacatgtagaatcattaaacaaaccactgtgggctggcttcccagggaccaaaaaccagctttcaggaagtctgacaaggctttataacttatctagtggccaaagcagagaacatacaaaaaagtgagacagatttaatacagatttgctttagtaaaactaattcagcaacacatgcagaaagccagcagaaagtaggcactggagattttttcatttgaaaaataaaaatcttacaaattaaaccaaaagggtgagtcatgatgtggtccctttgttattgagagaaggggggaaaattaaaaaaatgctttaaaatgttcatttatgcatggaaaatattttctttcagtgtgcctagtgctgtgtcaatcacttaccttttatagtttaattctcacagtactttaataagccacattattttattgtctgtcttataggaaacctgaggtttagagagtctgtcttcatgagaaaaacatgtcaaactagactccagtggttttcatctccacctactctcacagctgctcctaacaaaattgttcttggctattcaatgtcatattcctggtctccactttttgttaagtactttttatcacaccatttcgttcaagcccttccttcaaccactagtgcttatcagccctattgttatacccaggaccattttctcctaatttctccaaaccacttattgcttgacttctttccagacaataaagttcatcattccagccatattctcgattactgataaaattccctttctcccaggataatttttccctcatacccatatcttgcatgaatcctacagtcatcaatcccttttcttttatctgggatgctaaacactattctgacaaatcgcacagctctgccaaagggtgtaactgggaggattcagtaatcttttgacaatttcctagtttccaagtcagctttgtgaaatgtttgatggcttcatttttcatgtctctcatagttcctcaagttaccagagatactcagctgtctacaatctttaactgtatctaaaataacttttcttatttctctgttacttcaggggaagtggtgttttgttttgctttgtttttatttataaatctaaggctaatcttatttttttgctggcttgggccacactgaagtctattttatttcaaagatgagatgcattcaatagtcccagcctcaattatacggtgtatataaacatatgcaattctgcaagaaaagagacatgatgttacataattcatgtcattgaaaatttgtaatgtgtgtctagacataataaaacactgtataagtttatttaatgaatacataaatagaaacagtaatttaaaagaagcatttcagaaagaagaaaagagtcacagtccaagttcatgcactcttatactgtttgatataaatggaaatactttgtattgattgaattaaggagtatcaattataactatcacaccttttctaaaacacaccaaaggcgaacatactcatgtttccaaattataaaacccatgatcctttttaatttttggaaagtaacaatattatcatatgttgcactaaattttttcttacttttttttcttttctttctgttttttgttttttgttttttttttttgagacaaagtctcactctgtcacccaggctggagtgcagtggcatgattttggctcactgaaacctctgcctcctgggttggagcaattctcctgcctcagcctcccgagtagctgggattccatgcctggctgatttttgtattttcagtaagatggggtttagccatgttggccaggctggtctttaactcctaacctcaggtcatccacccaccccggcctcccagagtgctggaattacaggcgtgagccaccacgtccggccctaaattttttatacaaattattaagtcatcagaattggctgacatattttaaatattcagtttagaagggggtaagtcttatcactatcaaattaaatcagcattttctggccctcagtgatataaaaaaaagttaaattgtactattcaaaacttactgaaaaaaaacagatttttaaaagttctgatttactgttccataaaatcaattataattaattctcggatttgcatgtgatttaaaattgagtaaacttcaacaatttttcatacagtgatttgaaatatttgacataatattaaatgcttttaaaccatgcacaattatatttttcttagcaagagttaatatgaatatgtttaatatgtagcttatttgagttttgacatactctacttgataagtgcagagtatagctattaacttggcaaagactttaaaagagtttacttaataaatatagattctatctttgcttcatttcagtaatattttattatcaaatgttagatatgaatttatgagtttgcttttgaattataatttaaaaataaaaaatggaaaatttcagtatatatttccagtgaatgattaaataacagcatattataatgaaaagaaattaaaaaataggaaaactgaaaaacaagaaaggtatagcaaacatttgatcttatgttatacgataataattaggccagtgactattatcacttaaataagatgtatacagaagttggatgagaataatatagcaatgacagataaattgtctcaatctctttaagcaacctcaactctacaaagtaattttagacttatattgtttaatttaatatatatttcattgaagtattaattattgatttattagtttctttttaaaaatgcatcttctagcatcactgctactttaaatagatttgaaacagatttctaatcaaatttactcaggtaacctttaatagtttaaacaggttaatttttaatgtcatttatatttaaaaggtgctgaaaatattatagcattaaatatttaataacattgttacaaaattttaagtaagtcaagcccaaaccctagaatcatagagatcactactgctggctctcgaaacatcaaacaagtccattgagatttttacatttttttcataatttaataatgtggtttaagttgttgctagctttgcaaaaatatagtgtaatagcacagatgtgactgttaattaaaaagtctcttgtgggagcaaatgggtttctgggtgatgttttgagcaagattatgtcatttagaaaaaattctgagtacacaaaatcctgaactgtatgttcctaagagactactgcttaaaaaaaaaaaaaatcccaaccaccctgcagagtgaagagaagtaaaggtaatttgcagatcagccagtgtttttatatttcctgtaaatgagccatctcgctgccaatgtaaagatttgtgtttagtttttgtacaacatatcattcttaagggcactttcttcattttccagtttttgacaacgtagtgttgtaatatttaaaatgttttgttaatcatgtaggtgcatttgcaccttcatattaattttcaactcagtgatatttaaaatggctgaaatttgccaaaataagatttcatacataattgattgcattttacattagtttaaatgtaaaaaaattagttaagaaaaagttaacatgctgttctaaatcattacaaaatatgtagatttaaatataataaattcaactactgtttggtattaaggtattttatgcatcatgtgtcataaattattttcctaagagtatcaaattttccagatatgttatttaaataatattcactattatttaaagtagatagtgaatattatttaaataacctacattaaagaaaatatatcaatataagcacaagaaaatagatgattgttgatattaagtaatttaatgttatatgctagagcatcatggatgttgtattataatttccctgttaagatacacctttccagcacataaaagtttcctaaggaataaatcaagcaatttaccaaaccacttgactctcataagtgtatatactaatggtgactccattctcttagacatatacaaactcattcacatacacatatgtgtgtatacctgcacaacatagacataagtatacaaaaactcaaatatgtggagtgtgtatgcttgcacatatgggtgtgagtatatttaagtacacttttgccagaataaagaagaaatttgaggagcagtataaatttataaactttcattatcaacattcacttaattaagtacacttcattaatgagatttttttaattcctctctcctagaatttctttccccaaatttcagtaaatatgccattaacactagcatttagtatttttccgtttcttatttttttcgtttatgtccttaaggtttcctatgtccatgaaagtacaagccatattttgaaataaacaacctttctctcccaaacaatgttagtttcactttgccttaaatattctgaatttttattagtaaatataatacttaacattcattaaaatgtttgaatagagacttatgtggctttctttaattttggaaaatctaagcttaatatcatctatccccatcatattacagaaatcctcttaggtacatatttaaataggaccactaagagaagtctaaagaaaacccatgttaagaagcagagagttatgctctgcctccagaataaggcatatctacataagctatttggaagtcttttgcatgagtgatttgtatttatctcccctgtgtatttattcatcagatattgtacttacatcaatatggactaatggatatttattttgtactttatgttatcatccaatactactacttttaaaaatgttgttgcactgcttaatgaatttcttccaaagagttcagtatacaaacaggtaaacttagtaactgtatagtggagaaatccaacaaacagtactattgccaggtaatcaaggtccacatcaacagtgataagtcatgctcataacatgtgcccttgatacgtgatgaaagtgatactttacctctgtggccttccttccatctcccataaccccagtttaatcatgagaaaacatcaaatcccaatagggagatattctacaaaatacctgaccagtaattctcaaagctggtaaagtcattaaaggcaaggatagtctgagaaactgtcacagtcaacaggtgtctagagatgtgtaactaaatgtaatccattaggggaacctgcaatgggaaaattaagaaaaatgaaagagctctaaattggtaataatgtgtcaatattggttcattaatcatagcaaacatatcctataacatataaggtgctaaccgtagagaaaactaggtctggattgtatggggctagtactatctgtaaattccttttataattctacaactgttctaacaaataaagtttattttttaaaaaggcatacagatattaagaaacaactgtatactacctaatatttatttccacctcattactcaaacatgaaaacagaagaagactgaaatgaatatgtgcatttgggcaagacacgcatactgtggtaagtcaagatttgggtttgttctgcctcctgaataaattcatgttgggctgaaaaactctgatgcaattaggaatcagtcacagtttaattctcaaactttgttttggagctaggaagttaatgaagtggcttccagagttgatagaaaatagctagacaattggaagacccagtattttttgacctaaagaatctccaagcacatcaacccagatcgagacttcttgagggataaaaaggaaggcattgagaacacattattttcatccttagtccaaactaactgaattttatctttttcaaagtcaagtaagattgctggtgtcctaagtgtctgaatgctttaattctgctaagcagcaatcctgttgggatattaagttcatctctgttcatatttaattatgaaatattcatgaagaatgaagaaactcttgctagtcaggaattgataaaccatgaacttgatatctcaaatttgcgtaacatatagttcagaatctcaattttcttttttcttctttttctttcttctttctttcttattttttcctttagctcaatacatttactagaaataaaagtgtagagaaagtttagctgctcggctataatggatcaatataaatatctttaaaattttcaatatacacttagattttatatttatttaaattattctaataatctattgttttaataatttaaagtaataaaatatttctttttgacaccctgtgtggcaaatacctcaaggtataagtgtaaagaaatttttgaatatttaattatttttgtggcctccagctcattttctttcatttttgtgtctcttgttcattgtttatgtttgtttatagtcactgtggattcatctggattcatcatatgttataaagagagatataatcagtcattgtaactagatgactttattcacatattcttttgagaaaccagtaaaatataaaaagacaaaaatggaatatatttttggaagcatattttttagtttagagtgctttaataactttagtttctacatatacattgaaagtaatcctccagtaataccagctatacgactgtgaaaggaagggtgaatggcttatctatgcaattttgtttaaaatgaataagatctcaggactaacatatatgtacgacgctttggctatttgtaaaatgactggttataaaatataagaggaaccagttgttgaagatggtgagtttatatctatatgcagtttgagaatagttgtgtatgaatcatctctttgatagtcaaaagtagacatataacaggaaatttgtataaaatatagtgtttaaggtttggagataatattttcaatagttatgaatattcagggggtttgaaatgatgagaaagaataagattatctgtgaaataaatgtataaaaaatattaatagcccaaaggaatgactaatcataaaggatgcgtattatttttctactgctgtgtaatgaattgccacagactgagtgacttaaaacaatatttgcttattagctcacagttcaatctctcagaagaagagcatgatgtggctggattttctgctcaggaaattgagttctttgaagttgtaggatgggagtccccatttcttcagtgaccattaactggtcctcttctgtaaaccacctacattctaccctaaatagtccgatccatcttcaagccagtgacagtgcattaaatgctctgcttgcttcaaatctttccctctgttaaagccagagaaaaaagtctgcttttgaaagggctcttgtgattaggttcgacagatattctctttaccgtaaggtcaacggtgccacattacatgacataattttaagagcgatatctcctcatattcacaggtttagggtggtggtaccagaaagggatcctgatccagacctcaagagagggttcttgaatcttgtgaaaaaaaaattctgggtggccgggcgcggtggctcacgcctgtaatcccagcactttgggaggccgaggcgggcggatcacgaggtcaggagatcgagaccatcccggctaaaacggtgaaaccccgtctctactaaaaatacaaaaaattagccgggcgtagtggcgggcgcctgtagttccagctacttgggaggctgaggcaggagaatggcatgaacccgggaggcggagcttgcagtgagccgagatcgcaccgctgcactccagcctgggcgacagacagagcgagactccgcctcaaaaaaaaaaaaaaaaaaaaaaaaaaaaaaaaaattctgggtaagcccataaagggaaagcaagtttattagagaagtactgaaacaaaagaatggctactccatagacagagaagtggtatgggctgcttgattgagtttacctacaggtatttcttgctaaacgaagagtggattattcttgaattttacaggaaaggggtggagattctggaagttaccctatatagtctaaaaggggcaacacccttttagactatatagggtaacttctgaacattgtcatggcatttgtaaactgtcatagcactagcaggagtgtcttttagcatgctaatgcattataattagcaataatgggcagtgaggacaatcagaggtcactttcattgccatcttggtttcggtggacttctttcctgcatcctgttttattagcagggtcttttttacctgtatcttgtgccaaccccctatctcatcctgggagtaagaatacctaacctcttgggaatgcagtccagcatttcacagccttattttacccagcccctattcaagatggagtcactctggttcaaatgcctctgacaatggcacagctttgggaggccatcttggaattctgcttatcatggggtgcaggagtcctaagatactgagacaagggagatatagaggtgcaaggaggaaacgagaacaaatacgtatgataaaacaattggcgatcaatataggaacttaataaatgctcatttgttttgaacaaatagctttagagagaagcttcagataaataatagagttgaaaatgtaaagacagtagactgaagtatgaattgggatagcacagccgattactctttcaagaaacttaaaagagatgagaaggaaaccaggcagaaactaagaaggtcaaggatgagagggacgcatatgtttttgttttgaggagatccagaggagaggaagagctaaagaatgccaggaaaaaaagcaagtaaattagaaattccatctacaaagttttaaaaattaacaaaccacatgtgctgagggttcacaaaagccaacatagatttttttttctttttttttttttttacacaaagcaagtccttgcttgtttaacaatacaaaaggaagtagctctggcattttctgagtgtgttaacatctctcttggtatgtgtcttgcagttcctcaaagtatgtcttaattgcattctgagtgtattttccaaaacaaaatgatctgaaaaggtgatcaaatatttgaaattacagcactccaaaaataactagatacatgtttggcatacttgattaagtgagaaatttctttgagtttagtatttaaactgtcaaatttagaggaattaatagtttcgcttttaatatgttgcatattttctgacatcttagcagctgaatttatacaaatctctaattgttaactgtgtttttaaccaaataactacatgttccatttatttgtaattgattggcaaaagactcagaaaatcagctgaatacacgataacagactatttaatataaagtgtacactttagcattggaattgattattcatctataaaatactttaagacaaagaatctataaatagtatatttggtattgtgtcctgaaagaagtactagatttctccaagagttgttatttctattacatacatacatttttaaatacctttgtgaatgactattgtatatagcagaaataaaaccgagtgtagtgtaatataatcagtcacaccgagggcagtagtttcaaattaatgtttttctcccccaaaattatggctgtatcataaaattgtataattttaaatacaggtaatttttttaaaaagcaagttatttaaagtattttaaacaaattgaggaaagtctcataatttattgtcagtctattgaataattagcaatttcagataattatacttctagaaaaaatagaaagtaaaaccataataggaaaatattggtaactccaaaaaaaaaagtatcactagtcccatgacgtaattaggagtgagacctttggcaagaataacaataaacagcacttaatcaaatatctgtgtgtctagatggcatcttgtttaacagctttaacaaggcacagagcatgtccatgccttacgagcactccccttcccccaggtggcctacaaattggagaatggcttattttatttgaccatcttggtcactactcatgtcctcattgatgaagtcttttggcctccctgctttgtttggtttgaaagattcttgctgagtttgagagctcaggtacccaggatccagcctctgaaagtaccacatagagatgtcatcttgaccgtgtgcccactccctggaaagcagacaatgatcaggatatggattctttttggaaaccacacatgtctatcctttctctttttatttataggggctattattttttactacccttattttttactactaaacttaggaaactttcacttatgcatgcagcattgattacatatttttatctgtttcctcctcaactctcactaatataacagtaaaaaaaatcaaaataaaaaataaaactatatttcaacaaggggagaaagaatggaaaacttacagctgctgataagaaatgtcaacacattttgagacaaggaaaatggtgagtgattggcaactgacagagcagagagaaaaagataatcctcaaggtcatggagtcagtaacaagctagctaatttaaccccctgaaaaccagaaggcttagggctttgggagcaacagttatttctgaaggctgaaatatgggggaataatactggaaacagtatgactgaggtaaccagatttcttcactaagcctttgttgccaggcaaatgtgtccatcccactccagccacatagagaaagtttactctctaaatcagcaagctccagactctaagaactaaatgctgcagaggacagatgaggaactaagaattaatgcagatctgcataatgaatagtagcacctgtgtcctctctttctcaacatattttccaggattctttttgaggagtggagagaccaatggtaggcttacagctaatgacatttcaggatgtcctcaatggaataacaggctctcacactaatggcaaaaccctttactcaataagtgaaactcatccacaaattttctccaattattcctttagtgtttcacttttagttatatgtagtcaaatatgtgtccaaagcaacagcaaaaaatgacccacaaaaaaacgttttaaaaaatcaagtaaatcaggcaacataaaaaagaaaaaaaatttttgaaaaaaaaatgtgatcttatacaaaataggtaattagaacataaaaagaatcctattattttattttgacatatgagctatgaagaaattgatatgttggcacagctgctaacaggaaggaatcttccacttccctttctcctcttcctgctgattggcatgctggatccgccatcacaaataataaaatggaagccacgtgttgaaaatggcagagaaattagacaggttaaactggatccctaatactgtggagttaccatgtcagctcccaactgccaatataaaatcacctagctttctaagagagaaatattcctatgtgacttaagctactgttattcagagtccttctacagcaaccaaatctgatgttacacagttggtgtcttctttataagcacacagagactacaaaggaaaaaactgggaaaatgacgcaaatggatattgagagcaagtagtagtaaattcacaaggctaatagcaaaatatgtgcagctaaggaataaattgggctaaaaaaggacatacattgtagcttagaatgtcatatctaaccaaaatatcgattaattttgagactataaacaagaccatttaagcaagttctaaaaatgtgtacgttttttcgttgttcctcatgaagccactggagagtatatttaataaaaacgataaagtttaaccatgaaaggaaaaaatattaatactggaattgggaagcaagtacttaacacaggaaaaagcaacaagacttcccaggaatacaatcaaaagaagttccatgacaatatctgtgtagcaggtctagaacagagtacattgaaattggaaggttaagacagagtgtttcagaaagaaagaacacaagtggaattgatagttcacctgataaaagtatttaaacatgttgagaagagtttcatagttctctcagaaagtctgggttaatcaatcagtgataggcagaaagaaaagacacacagatgaaataatcattgatgccaagaaaagcaagatgctgtcaaaatcagtaaacataatcatcataggtcataggggtctgttctcaatgctatttatagtcataaaaatgtaaccgctgattattgagccggaaattgagatctgagagtactgagataagtgtctcacaaggaaactgacaaagagggcattgaatagaacggttacgttcttatctttcttagtaggcagctaattgttttctaaaatgaaaaggtctctaaatggtaatatgcattataccagtatttagaaatatggagaaatatgccagaagaaacagtggaatgggtgatatgaatttgtctttggggagtagaaatcagaggtgtggaggagatgagacaaaaattgctattcttaattgtacatcttgtagcactactatttttataaacaaagcttatgtatttaagaaaagtaaaattgaaaaagacttgtcttcttacagttctttatttcagtcctattaatgttcccaaggcaaagaaatgcagactctcatcttgcttggaagtgaaagagtatttctgtcaagacatttttagttttatcagttataatgttgtcccagcacctcagtttgtatcaatgtcagttggatagaacaaagaaagaagctctattttctgctttcctgagcactgaccacctcatcactagctatacatcagtatttcagtaagcagagcgtattgaagtgaggcaggatcttacatttcctaacccaatatattcattagacttaatctattgttaattgcttaactgacatccaaataatagatacccttttttttgtttttgtttttttttttgagatggagtctcgctccgcgcccgggctggattgcagtgctgcgatctcggctagctgggactacaggtgcccgccaccacgcctggctaattttttttttgtatttttagtagagacgggtttcaccatgttagccaggatggtcttgatctcctgccctcgtgatccacccgtctcagcctcccaaactgctgggattacaggcatgagccatcacgcccagccaatagacacacatttagtactaattatcttaaaggtatcagactacctttgatggaaatgacaagaatatgtatttatatttttctgttgtcaaataatttaatagcattgaatcataatcaatagctctatggggttaagcaaagcatgcacaaaagtttctataacttttaattaacatttttattgtgcaatgtgattaagaaacaaaattttcacttttcaagcctttcattgctagtttctttcttcccttttgtctttccttcctttctttttctcttctctttttaaacctcttctttttggcctttccagaaatactccataataactatattgctttcaaacaatagccagagcaaacctcatcaatttaagaatggagagtgcatcacataatgagtttatgtctgtatctctcttaccaaatggatataaagtgacatctcaggggtctgttaatgagattgtctcatgtaagggaatctggtaatgggatgctaccaaatctgattatttagagataatgttaacaaaattaaattaattaatgttcaatttgcccttcacaagcaaaaaaatttaaaagagttaatcagaaagatcatgggatactggtgattaaatatattttaagatcaaagtctagaatttgcaaattgggaagttgacagaagaaaagtagctgtgcatttgaaaaaggcatttgaaagaaaactgttttcaagcctaacaagaactgattccccttgatcatctgaggctacattaggcgggtcattcttacttccagaattacacatacaattctattttctgaagtgctcttctatttataaattgtttctccttcaaaactactaaaaagtcacacattatatgtagcattcttaacatgagtttcagttcccacaattgaattgaagccatcaattcccatatataactatacacttacagatgtaattgcatttgtttaccacaatagctgtgctattggtaatgaaaatgcacactcacaaggatcaagtaacctttctgggagaaatattttgggtagaaataccttagataattagtcacactgtacagaaatgagttgaggtataaagttaagaaaatacattactgtgggtctttactaaagaactgattgttgtacatacatcaaaacgaaaatgtcttaaaaataatgatcttaattgcttccaatgtaacacttcttatatgtaatataatatgtattattatattgcatatgtaatataatatgtattatattgcatatgtaatataatacgtattattatattgcatatgtaatataatacgtattattatattgccagtgtgcataatacacagattgaagaaaggtcacagaaactcatttctgagaagcaggcagtcatccactcatgggtagtgtgacggttaatactgactgtcatcttgattgggttgaaggatacaaagtattgttcctaggcgtgtctgtgagggtgttgccaaacgagattaacatttgagtcagtggactgggaaaggctgacccaccctcaatctgggtgggcaccatctaatcagctggcagtgtggccagaatcaaaagcaggcagaagaacgtgaaaagactagactggcttggcctccccgtctgtatccttctcccacgctggatgcccttgaacatcggattccaagttcttcagctttgggacttggactggcttccttgctcctcagcttgcagacagcttattgtgggaccttgcgatcatgtgagttaatacttactaaaccctgttagttctatccctctagagaaccctgactaatacagatggactggtgggccttgtaaatcattttattttaatcatgttcagtgaaaagttttcagaagagagcgatttaatttagcttcatttttttaacaaagataccttgttgaaaacaaaatggattctactgaataaaatgtaagcagaagcacagtaatgaactatcttatccagttaagagattaagaagaatagtatgaatggagaatcttaaaaacacttagttaaatttcaacctatgtcattgcagtttgtaatattcagctattcattcaacaagtaatcattaaagaccttctatatgcccactgctatgttaaaattaggatatataatgatgaataagacatggtcactaactttattaaaggctgaaaataacatgaatacataatttgaaactggaatagtgctacaactttattgaatagagtttttgaaagggaaaacagaatttatttaaatttaattatgcccatctaagagaatatttaacctaagtggtgattaccatagcaaagaataggggtaattctgtataggggcatgaataaagggtgtaaagtggggatgggtttgactgaatgcatgacatgtgttagaaaaaattgcttttatcaagggtaaagtgtaaagacataaaattacaaaaagtaacaataaataacaatttcaatgtatgcacaataccttgacaatttttatttaacttaatgtacaaaatattacccacagactatgcctatagaatatgcttctggctaggaccgtttcagaattcatggagaaaacattttaaaaatacatcattagcaaacgcatctttcctttttctcctcagaatgatcattatagcccagctcaaataaattttgacatttttcaaaattcattatatttcacattagtgtaatatggcattaaatatgttattacaaatgttaggtgaatccgttgcaaagagggtagctcacagtccactctccaatgacattctacctgggcatagtcagaaattggctaaaggtataaaagaccaactcactgaacaaataaagtcagcaaagtcttttttattgcaacttgaaaaatgcagatattgttaacatcttttttatatagttactatttgaacataatggtgatatgaaatattaaatctttctgtttttcatagccattgccaacaaacacactagttgtgagcaatataaaactatgagggataagctctgaggtggacttatttttcgtagaatatattttaatggcaaaagtgcaccaaattaaggttatcacaccgaaatatacatcaacaattattttatatgttgagagcgagttggtatgaaaaagaagtcacacaaactaagcagtgtatttagtgattagcatttagtgatatgtattgtaatcatggtatataaagacacatgtattaaaatcaaattacactttattaagtaataatataaaaataaaagaattatcttaaaacaattgtaaacaaatggaatttcatgccaaaatattatgttttcaagtgcaaaacttcagttgggaaaatttgaactatagaagaaactctcagtgtttctgtaagacaatggttcagtttggtcccaactttttaaagatatgagttggacaaacttgcttatatgtctcatatatttggtattttaatgattttaatttctgcacacaaggaagaaacacaacattgtaactggctgttttaaataacagataagatcaaagggcacaaaggaaagtcagaagtttggaaaaaaagtgtttctaagaattgttatgacatgtttcatagttaacaacaactatcagtgaagtaggtcatgatctcactattgtacaccgttgaaagttatcaccaatctccttatgaatttaatacaatgttttgtattttattttttctcaaagtagatacaaccataggagattcatggatttgaatctgtttttttatttgtttgtttcattttttatcaaaaagcttattgaaatttaacagctttaaactgtacaattttaggcaaattaatttcaaaaatagaacataacttccttatttagataaaaattgtaaatgtatatgctgaacttgctttataatcctctcccccattcttgtcaaaatgcatctctgagactgactaatttaccataagtattttttaaacaaataatagaagggtttaaatacacattatgtcctgtgggtgatgaggttataatctactttagatgtgataaattaatagggaaatagcttggacattcgtcacattaaacattttaaaaattcatgtatctgattaaaatagacctgaagatttttgatacagggaattgctacttcattcataaatttctgtttaattataatgtatgatgacacaaagttacaagtacaagagtggttgtcttatctgcaaaatggtcactttcaatgatcaacaagtacatgtttttgtattttttgatgctataattgtcttgcatattttattgaaataaacatttccttgttaaatttaatacttaaaaattgtgatttatttttgtatgtcttaaaatttcatttttatagagtttcaatttttgttgggtttttcaaaagtattggtctatgacaatttgtaggagaaatggtcctataccacatatggtattagaagcattagtataatttacattcctacaactcgttcttcttgtggcctatcattctccacacacttctttttaaagctcttattaattaatttcttctttttctcagatataaagcgttttagttgcaagaaattatctacaacagtttctgcattattttatatgcctcagacatagtagtttaaaaatcaatgagtaaataattatggtaattcaacacacttatacagttttaattctttacaggtacaatattcctatatttaactaggcaataataaaattttctaatacttgacatcatgaaactgaattgacaggaacgtcactggaacataatcgttcaaatgcctatgcaaagttattctacaaaatgccaatggtttctatctggctatgatctggctattccaatgttgggtgactgttatattcttcttaaagctctgctatattacattatttcattctataaggtatagacaacattttagaaatattactgaagttcaaatacagcttccaagtattatgatagctgtgtccacttacacttgataccttttggtttgtttgttttttgagatggagtttcgctcttgttggccaggctggagtgcaatggcacgacctcagttcactgaaacctccgcctccctggttgaagcgattctcctgcctcagcctcccgagtagctgggattagaggcatgcaccaccacacccagctaatttttgtatttttagtagtgatgggatttctccattttggtcagtctggtctcgaactcttgtccttgggtgatccacccaccttggcctcccaaagtgctgggattacaggtgtagccaccgcgcccggccacttgatacctttttatgttgcacgtgtttcatttcattcaatattatttaagactgtaggaaattacacatataggttcgccaaatggcttgtgcttgtaccccaattaaatcaaagacaaaattatacttttgatgcaatgctcatttaatgaatgtttactgagcacctatgttaggaatgttataggcattatgtgtataggaaaatgaataaaacagacagaaatctctgcccatataaggcttattttctaggtgggagaatgagcccaacattcatactaactcctttcaggatgatcagaaagaagataatatgtgcaggtggaagtaacatatttatataatcacagtgctatataatttcattacctttccattattaactttctcagcctcttttattatacaaatatagtaaacatcctctgaaggatgtatttcctctcattacaatggttactatgctttttagtcaaaattatctacagttgatttctcaaaatagcaaacattatattgagcttacttagcattccatctattatactatggagagtttaacagagaatatatatacacacacacacacatatttgtacacatatatatatatccatgtatacacacacatacacacattgtccacataagacagaagactacctttcagctatttgtgaaataggtttattagaaacttagtaaagtattctgtggtgtaatatagtccaactagtttaaattattcatttcatatcctagtgcttttttcccacatgtgctactttattgttttaaactagttgatttataaaaatgtcatctgaatagtgcaaattaatgattccagcaaaacacatttgcgataccttaggtatgtgacaggcaattaaaaaaagttgtattgatttgtctaaaatgttaaatgacataatagccatacagtaaagtattgaataatttaagtaaatcaatgttttctgttttctgaattttctaggtgtacaaactatcttgggtgctaaggtaaatcaatataataaaataaaaatgaagcggtttataatgatgaatgtatgggttgataataaccagaggtagaatctcatttagccattgtaacaaacaacttccaggcatttttgtgcactattcccatcagaaaacatggtattatagagtcaattgattttagcacttaaacagcttttcatttgcaagacacctagcctcagtataaactaaacctttcccagagtgtcattagttatggcttgatttagaatgataatacatatttactaccattagagccattttgtgtgttttatgtggtttgtaaataatgctatattttatgaggaaatgagaggtgttcatttgttatgctcgtatatagttgcaagatttagaatttagcattttgtgcttcttctgatctctttttactcgcatttccaatagcaaaattcttaagtaaataatccacttggaaattgtatttttcattcaatatagctatgtctttatgcattttttggtttcatcattttgtttagaaaataaaagtatggtaaaaatgagcatgcagggacaactttttcctatataatgtcttttgtggtttacaacaatttcaagatctaataaaatctatggatctttcccacaggaaaaaaaaatacagatgtagacatgaacacaatgttgtatataatttaagagaattcagatgtaccctggattctcttcacattcatacacaaagaataaaaattaaaacaatggaaacagccacaattagcagctctgaaaacttcaaatgcttcagtgttataactacacttaaaatgatgaaagtagatagattaatacacaaaaatacgtaactcataatacttttgcattttctacaaattcagaagaagatcccataataaaagaggccaaagacactagaacattataaagaaaagagcggtggagaaaaaaggagtcactcctggagaagagacctaaagtagtcaaaggactaacacccagatttcagaaaaggaaaaatataaaatattattgagtgttggtagtaaatcttggtgcctcaggcatggaccccgtaggattgacccatggtggctcagccatggatccaggattggatcccagatcgctacttaatattgtaaccttggtaaaattacatcatctctctttgagagtatcctcatctgtacattggggacaataataggatttattttatatgtctgatgtggacatgaaatggttccatctatataaagagcttagcagaatgccttgcacacactaagcaggaagatgggtacaaaacttcctacctgctctcatttttgtagcagcctgctttactgtgagagttgctctgaactaaaatgtggcaaatcttgggactgaggaggagacatgagatgtttgtttggaggaacagccaggctaattaggctccctgctcttcacttactcataccaaacagtagacaacactatcttcttgagaaaggggcagaaggggtaggccttttggacagaaagcagggaagaatcctgcatagagacattgggatacccaaaaagtttccatttctgaagcataagcatgcctgtcctctcccgcatcatcaccgcaggcagagcatggtaagcatatattgtacttgtaaaacaggccatggacaatcttagattcaaaacatgaggatcaaacaagaatcaattaaattttcagaaaagataacctcataaatgtgagagatcaactcaacaaacagaaaataaaaaataacaaaatgtacaccaacatataaagcaacagataaaagaatcaacacaaatataaattataacttcagagtaatatgggaggcagcatttccatgaagtagcatacaaagattttcaaaattaaaatttttgttgtgaagaaaatagaaagctaataatgagctgaagagcagaatgagaacaggaggagagagaaacctgaggaacaggtaaatgaaataagacagctctctcaggggaaagggccaatatttacagaaagagaaactgtgaaaaaatatataatgggtataaaagaagatgtataactttggcagggagaagtggctcacgcctgtaatcccagcactttgggaggccgaggcaggcagatcacgaggtcaggagttcaagaccagcctgaccaatatggtgaaaccacacctctactaaaaatacaaaaagttagccaggtgtgggggcacagacctgtaatcccagctagtggggaggctgaggcaggagaatctcttgaacctgggaggtggaggttgcagtgagctgaaatcatgccactgcactctagcctgggtgacacagcaagattccatccgccccccccccaaaaaaaaaaaaaaaaaaaaagaggtataacttctagatggtatgaaatagaaggcaggggtgagaacattaaaaagtaggaaagtattacatttgtaaaacagagggagaaagttaacatgttgtctaaacagaactagtagtataattatagtgttttaaaataaagcatgtaaacaaaagaataaagcagaaattaatgtaatttaaatctactctgactttatccctcaactccagactcatgaaatcaacttcccatttagcatctccattacttgtctaaaacatatctcaattaccgtacgttgaaacagaactcttgactttctccccaaatggacaagacttctccattggccttctcatctcagtaagtggaaattaccagttggcaagaacagaggattttaagttatctctgactcttattctgttcttcaaatgtataaacattccaacaacaaatctattttgctctcatttcaaaatatatgcaaaatcctctgaattctcaacacctccaccacttgtaactttttctaagcttccagttttgctttcctgcatatttatttgactaatctttctacacaaaatccaatttagcctttcacaacctaaattagataaaatcactcctctgctcaaaactctgcaaagactcttcatcttattctaaatggaatccaactctttccagggtctcctagtttctctatgatttagcctttggctacctttcagacctaatctcagttatctccattctacctggactttttgttgtttcttaaggatatcaaaggctttttgcatttgttttagagtctttgcatttgcttttctctctgttcaaaattcactttgctgaggtcttggtttcttctcacgggagttgttagtgatccccagacatccatcacccctctattccaacatccacacccttgccaccattgtgtcacaaatatgctggaatagatttcatcacaccctctcatgctgtgtaaatggtcatcacaaaacacctcttgttctaccagctatctcccatactctactcaacaaaataatccaaatctttcttatcctcatcactttgtcatccttcctaaaatctttctatcatgccttttgaaaatccactttatggtctatattttctatgaacagtccattaatctgcttattccaatgaaccttgcctccgctggagaggtcaatgtttttgccaactctccctgacaaaagatttgtaaacaccaggtttggatgcaggacacctgtctctcctgctctttatatatccttgagaccattttctctcccatgtccctaaaactgcccaactttaaaatgtttatcatcacttcatattaccatttatgaagctttattgctgtcacttctcaatacctggaccatttacccttatttccggatgacttcagtttctagttcactgacattttctttacaagaaaccctgtcttaattcttcatgattctagtatacacatagatcatccagcacactaacttctcaaatccttgagtcctctcctttgatgctcttattcttttctccacctaggaaatttactggttttgtcattacaaacaactgcaaaatttttgtaatttcagtttcattcatcccattttctgaccactacttaactaggatttgaaggctctaacagttcttctaccccaaaggggcttcaagtcttactacattttcactgcctgtagctcatttgatgttctctttttctgaaccagcttaaataccatgatcaatgaaaataattctcttttatacaattccttgactcctctgtatttttctcactgtttaaactcacatggcaaaaacatcatttttggttaaatccaacttcctacctctgtttctgcagccacgcatcagattgacctcacttaatgatacaaaagaagagtgacctagtgggctgtctgacaatcacacttccctacatcattaatctctcactctccttgatgactgatctatttctctcctcaaacctccagctctctcctctccctaattacagcggatacctttgatttatctttgctaatgtattggaaacattgggaatgatgttctgcagattcccactatcacgtgtacccaaccatcaacatctgcacaccacaccctgcctttcccactgataacttcattgactgacagttattatgccaagccaatccctccacttactttctagactccatcctctttctatttaagtatattgtttagcaattttccactctctcttgctgattttacaatttctgctgctgtctccccagcagcaaacaaatatatgacttctctttacatcctaagcaacaaaatgaaataaacaaaaacaacaaaaacctgcttgcttctatatctccaaacagctaccatccaggttattttctctcttttgcaaaatacctcctctcgtcatttttcttaaatccattcaaatttgactatgatccctacaaatctactaaatattgtattcagatacaaagttaaccaataataatatttcacaacatctccttttcaaaacaaatttcttaacagcttattatgaaataagtcagttgaaagtctgaaggagtaatagatgcaaggaagaagtgttgtcattggaataatctacttcattcaagatctaacagtatctaattttagaagaggaaatatattattattaaatatttgaaagatagcaacaaattaaaatgaaaaataagtcattttattgataacaaagctatttttatgtttattatatatgaaaagcaacttaaatttatgttattaaagtttctgcttctctaaatagtttggtagctggatatatacctggtaaatattctcattcatgaaactctgatcattaattacattggttaatgtttttgaggctttaaataagtgtgaattgagaacatattgccaaagttgatttctccctcacaatcccatcaaaattacattaaatatgcaccaaaaatacaacatttctaataacattggttatagaaatacagatacattgacagagaccaggaagacagaaaatatctttggcaactaattaaatggttgccaaataaaccatcctcctccaaccattacacattttccatttagaatgattgttatagttgcataaagggattaaatctttaagttgaaaagcacacagttccctgacctagacacatagaactatgttttcaatatttcagtgaaaaatagataaatccaaaggtttatgttatgaaaaaataggctatccacaatgaaataagaattaaaaaaccatcacacttgtcacaaaaaaacacagatttctaaacttaatgttgactgataaatatttttaaaaactgcttcaattattatcctttcctgtggtccaagagagattttgaaggaaaaaatacaaaaactagtacatagaatataagactgtttatgtttaatctgtacatctagctgggctctatgtatgggttatttgcagaagaaattgccaaaaagcaagcagattggaaacccatttcatgtttcactgaaaatatattgttagacttcatgttagtctacagaagcctgagactgttctactccaatgtgcactaacaaacatttagctgcaaatgatctgtaaatttcaaaatgattacagaggataaaagaaagaaaggaccacttagagcgcaaaaccaacatcatccgacagcagacaaagaattcctcccagagagcaaaacggggctgaaaaataggtttaccagaaaatttacctccttgccttaaccaaaagtcttaataattctgacctagcaaaatatgataatagctataagccagcgtacttcattcattttgatggtggcagtgtttgtctttttttcttcttcatatggtatgttatattgtaattacctatttcaaccaaactgttttattttggtgtttactgagtgttggggtgagcagagtgtgcaaataacctgcctttgttcttattttttttttttaagtttagttaatatgtagccagatcccaaggaagacaacacagcagccagaaatccagaggtgaatgacataatgggatagaatttcatggctgctagccgggctcagtggctcatgcctgttatcatagcacgttgggcagccgaggcaagtgggtcacctgagggcaggagtttgagaccagcttgaccaacatggtgaaaccccatctctactaaagagagaaaaaaaaaaacagccaggcgtgatgatgcatgcctgtaatcccagccacctgggaggctgaggcaggagaatcatcacttgaacccgggaggcggaggttgcagtgagccgagatcacgccattgcactccagcctgggcaacaagagtgaaactccatctcaataaataaataagtaaaataacttcatggctgctatatgaaaatacaaagacaagcaggcatatttttggcttttcaagagagtgaattgtggcagtaggaggtaaatgtcctctactatctcttcttacaatgaacaatggtcatgctgttaaagataagatcccacaacctctcttacagctatgtgtggctctctgactagattaggttctaaccaatgcaatgtaaacttgagagctatctgggttatttccttcacagaaagagaacccttccttataccactgcctttcctatttcttcctcccttttgccaaaatagtgatatgatggagaaaattggagttgacatattggaccatgagaataaaaccatgtgttgaagatgacagaaatatgacacagaagcccaacaattatggaactgatttgcagcaaggaccaccttgaacttatttgaggaataaactatctttttattaatgtctctattatttgtagtcatcctcactcagccaactccattatctattctaggcaactgaaaacaagattccaaaaagaaggaggttctatgaagaatgttgtattagcaaggttaatttaattaaatttaaagatttggaagttggaagataaagatatctctttggtcaacaaaaatgtagttttcaatcagtaaaattcatgttgtgggaaattgaaatacttttatgtgacatatctatgtacaaaaacattaactagagactccagaaaatccacaatactttaaaagtagttatggtgtgatcataaagcaatctaataggtggtatagttttgagcaactgatagagagtaaaaaagaatgcatttaacctgatagtcttaaacattcttcaagctctttaaaagcaaaggttttcattccttacttaagagtccatcatggtacttaaatatgtcagtaatagtatttacacagccataatactgatttgtaaatatacttgagtggcatcataacacataataatttaaaaatgcagtccctgatgacagatttccttcatttattatgtgttaaccgttcagagttttctaaaatctttctatatattagtgtttccatgtacaaaactgggttttaaaaatagaacctctttcaacattaacagatcaaagaaaatattaataccgtatgatcatctcaatagatacagaaaaataatgagaaaattcaatatgctttcatgataaaaattgtcaacaaattaggtgtagaaaacgtgtacaataaaggccacatatgaaaaaacccacagctttaatcatacttaatagtaaaatacttaaagcttttcctctgagatcaggaataagaaaaagatggtcattctcactactttattaaacatagtcctacaattgctaaccagagaatttggtcaggagaaagaagaagatggtattcaagttggaaatgaaaaagctaaattgtccatatttgcaaatgatatgattttatctatagaaaaccttaaagactctaccaacaatcttctggaatgaataaattcagtaaattttcaggatacaaaattaacatacaaaaatcagtagtgtttctatacattaacaataaactctccaaaaaggaaatcaagaaaacaatcccattcacaatagctgcaaaaaacacttaagaataaatttaagaaaggacgagaaaaaccttctcactgaaaactataagacattgctgaaagaaactgaagaagatacaaataagtggaaagacatctcctgtcatagcctggaagaatcaaattgttaaaatgcccattctacccaaagtgatctacagatttaatacaatccctatcaaaattccattttcgtataaatagaaacaaattctaaaattcagatagaaccacaaaggatcttgaatagccaaagcaattttgagcaagaagaacaaaactggaagcattacactacctgacttcaaaatatactacatactatagtaaccaaaacagcataacaccgccataaaaaaaaaacagacacatagactagtggaacaaaagagaaagcccagaaataaatttatgcatttacagtcaattggtttttgacaaagttgtcacactaggtgtggacaatctcatcaatagattgcggtgggaaaactggatatccacatgcagaagtatggaatgataactttatcttataccatgcaaaaacaactcaaaatggactaaagccttaaatttaagaaccgaaactgcaaaaccactcgataaaaaaataggggaaaggctccataacatttgtctgagccatgatttttttggatatgacccaaaagcacagacaagaaaagcaaaaagacacaaataggattgcatctaactaaaaagtttttgcacagcaaagggaatgatcaactaagtgaagagacaactgatggaatgagagaaattatttgtgaatcacatatctgataagggatcaatatccagaatacacaaagaactcaaactactgaattataagaaaacaaataattctatttaaaaatggcaaaaaacttgaatagacatttctcaagaggacaaatgcccaacaatatatatttacatatatatacacacacatatttagtatgtatatacacagtatatatacatacatatgtatgtattatatatacatcatatacatgatgtatgtattcatgtgtatatatgatgtatatatgaatgtatatatacacacatatatagtatatataaatgcccaacagataaatataaatatactgtatatatactatctataaataaatatatatgctatatataaatatatatgcccaatagataaatataaaaatgtctatcattaatcataaaggaaatgaaaattaagcccacagtgagacattacatcatatattttagaatgactattgtaaaaataaaaaaatataacaagttttggtgagaatatggagataaggaaatccttgcacattgctggtgggaatacaaatcagtacagccttcatagaaaacagcatggaagttcatccaaacattaaaaatagaactacatgtgatctggcaatctcactactgggcatatactgaaaggaaatgaaatcactatgtcaataagatatctgcactcctgagttgctataaatattattcacaatagccaagatctccatcaatccatgaacagaaaaagaaaatgtggtaattataagcaatggaatgctatgcaccctcaaaaaaaagaagaaatcctgtaatttgtgacaacatgattaaacctgaaagacattatactaagtgaagacaggagaaataataaaagttcaagagactcagtgtacaacatagtgactaaatcaagtgaattaacatatgtattacctcacatacttatcattgttttgtggtgagaacacttaaaatcgactctcttagcaattttcaagaacacaatgcattttttaattcatagtcaccatggtgtacactgggtctcttgaacttatttctcctgtctaactgaaattttgtatcctttgaacatctctccaacctcaagtttacctccaacctttggtaaccactattccactctctgcttctacgagtcaacgttttaaggttccacttataagcgacatgcagtatttatcttactgtgcttggcatgcttcacttagcacaatgtcttccaggtttatccatcctgtcacaaattacagagagtagattttaactgttctcaccacaaaacaattataagtatgtgaggtaatacatatgctaattcacttgacttagccatttcgcagtgtgtacatatttcaaaacatcatgttgtacccaataaatatacaaaatttgtatttgccaattaaaaaaattaattaattagaaaataaaatagaatctcatttacaaaacacatttctaaaaatacaaccttacttataggattgtcgtaatcataaaccaagattatttatctcatatacttagtacctagcacagtgactggcacaaaataaacacctgataattatttgctacaatggaatagtgttcaatgtgttccaatacatagcatagatctttaaacaaaatgtctttagattattatagatatagtacatattaccaatgttataagccttgactttggcaaagaaaaataaatcagagagtggcagaaagtacagctatgttacttatatttaaaagtgagaaagcaatatatatcatcaattaatatatcaattttatatatatcaattaataaatctatcgaaatgtgatggatccaacaatagatttatattctattttaaactgtaaaagtaattgatagagaaactatgagttatataattaacaaaattttgaagaggaagtggaagatgaaagagatagaagttaacagggtttgtaatttaggtccgtcaactgtctcctattactagtaacattgcgtgcatctttattatgcatcatacacagttctgaacactttatgcatattaactcaatgaatcctcacaacaaacttataaggtaaatactattattattctatttttaaattaagcacagaaaattgaagtatttttctcaagacccaagtcggtcttaggagtctgaatccctatatttattgcccctaagaatagagaagaagcatacataatctaaaattttatcttgcattttaattgtattcattagagttattgaggtaataatcaaattaaataaaaccagatattttaagaatggagacttatggagagtaggttataatttggagattataaagggagaattttacaatctataaaatttgttttcttattaaatgttttctttttaccatgtgagtgtattacttgtattgaaacaaaacaatattgaagctctgtggacactttttcattgtggaagtcacaaaagttagtttgttatttttataattattgtattgccagtcatatttataataatttctgttaactgttatttttataattattgttttgccagtcatattcgtaataatttctgagtcttttgttctaacttttatatctacaacaaatatttaaacatgataaattttaatttaattttaaaattatgaatattaacttataatcaagttataattgtaaatacattacaaatttgatgattataatatattctttgctttttagtaaatctacatttaatttgttaatggatttttttttttaatcagagctgggtaaaagttagtgaaagacttctcactgtaggctgatctccccagaaagatactggtctctaatgaagctccctgaaaatggccaaggtcaagattaataacagtgcttcaatcccaaacatgagttggtcacgtaagtgggcaaggtgttgttctccccatgaggaatgttgaaacggcaaatcatgcaaccaactcactgcagcaaacgtacagatgcagatgtcatacttgcaccccaggccctgatcatagcggaagaggaaatggcattacttcaaccttgaaccctgtgttggtaaatcagtgatagagccaagcctccaccagatcatattgtgctggtcacagctcctggtatcacagcggaagggcctgggattcctgaaacatgttgcttaaagacctcatagacaactctttgaggcacacatagcggtggccaactgggaaccggcgcactcacctacaacttttcagtctgtgagattttcaaatacatactcctcgggtaggtctagtgtatgtgctgtccagtgacttgctcttgagtgtaatgatatactcatacatgaacaaagtatttataactagaaaacctaattataaaggaaataaaaagtatatgtgaatctatttatacttggaatcaagcgagagtaaaggtagctctgtcagcccagctgtataagggcaccagcccatagacctagaaaagaaactgggaatgtgtcactctggaaccagaatggactcagatattaaaatagaagaaaaagatgtaatcattcatgatttataacctaaattagtcactgaggtgaatatatacattgcatattgataataagtatggcaatgatacaaattttattttagataaaattgtattttgttaatagtacctccccctggtaaggttgacggttttaaatattttcttttttttttttttcttttcttttcttgagacggaggcttgcactgtcacccgcgctcggcaggagtgcagtggcacaatcttgactcactgaaacttccacctcccgagttcatgcaattctcctgcctcaacttcccgcatagctgtgattacaagtgcccaccgccactcctggctaaacttttttttttttttgtatttttcatagagacggggtttcactatgttggccaggctggtttcaaactcctgaccttgtgatccaccctcttcggcctcctaaagtgctacaattacaggcgtgagccactgtgcctagcctacagttttaaacctttacatatttttctaagctgtatctttctatgttttggtttgaagtggaacgtctttctttaaaaatagaggtgtagcatctgcttaattcatctaaatactattcagacagcattagccatcaataaagttaatttttgagacaaaataatttatcattcttttgttcaccttgtttttgttctgtacatatgacgatatatcgatcaatatcattaccctttcatggaaattttaataaagtttagacaaatgagcagcttcaaaaacattttaatcccccatttattccctttaaggctgtgtctaattttgtaactggcatttgacaaggcaatgagtcttctttccagcctgctgttacaatattacttttgcatgaaattcccattggaatgatatgccaagaaatatgtttctaaattcctttttctatgatgaaaaaattacacagtttcaaaatatttagctacagtgaagatgagaaattaatttttaaagaatctacattattttaaaaatcagaatatttttataatgttttgatgcaagatgcttacaagtcttggccatcattgtagttcttcatatttctcatgcaaactcacatgataaactataaggtgtgtgtgtgtgtttgtgtgtgtgtgtgtgtgtgtttctgttttgcttcttagacatgctcttggaaaacagaaaatgtggttcttcatgactgattgataacagtcatctcttgcgtgtagtgtggcagtgacattcttatgacagggaatgaagctatacaggcaggtggaaaaaataggactttcaaatgataatcaaagctatgtcaataagaaatgtttttaaaacacaggctagcttgggagtagaaaactaatgagtaaactttttttttaagagagagaaaagaaggtatttttctggaaagaaagggcattagtttttttccattctacttctgtgtggtgtatagttaatttgtgtgctatctgttggtttcagaaatcttatcagacctgacagaggtaacaaagaagcctgtaggtttaaaaaaaaatgcaaaaagttgagccattaaaatcagtgctccgccaggcatggtggctcaagcccgtaatcccaacacttccggaggctgaggcaggcgaatcacttgaggtcaggagttcgagaccatcctggtcaacaggatgaaaccctttctctactaaaaatatgaaaattagctgggtgtggtggtgcatgcctgtaatcccagctactcgagaggctgaggagagaaaatcgcttgagtgcaggggtgcggaggttgcagtgagctgagattgcaccaccgcactccagcctgggcgatagagcgatagagtgagactctatctgaaaaaaaaaaaaaaaaaaaaaaaaaagcagtgctcttcatagtggtccatggatcaccggaataattcatactttactagatcctccactagaaatgcaaaatcttggtctcaatgcagatctacagaatcaagatgtatttagtttgggatccatcaaatatgcatttttggtgacttttgtgcattttctcttttttgtgttattttatgatcagtgccacctcttcttatctgagggggacttcttagtttcataagttactgagttaataatattacataatgtgatgctaatataatctttcaatataattctatggctgaaatgattgaagatatggtgctgcatagagaaagaaaatgctggttcaaaggaagaagaatataatgacagcgacgagagcttattgtaggttccaggcactgccctaataactttatctgtattaatacttaaaatggtcaaaatcgactccccatttttcagatgaagaaactgaggcacgacaagatcaagaaacttgctcaaggtcataacaatcaggtggtggggctgtactttaaggcaatctgtctgcagactctgccatcttaatcaccatgccatggtatgtgagaataagtaagtacggcaccatgttaagggtctgggatgtagtctacatgctgtgttttgctacaaacccctctgagactattgcacatgctggggaccctctctccagaaacctgcacagatgcaaggactggcctaagtttgcctataattttaagtagctcagaccccttagagcttgaaccaagctcatagatcacagattataaaatgggtgtccgtgggaacagagcgcttattttggcataggctttgtaattcatgaaagttttctcgttttaaaaatttctgtctgaatttcagatttgggtctgtatttacctaattattccatattgacataatgacatatattgggaaatttagaaatgtcctagaatcgtctctctacagaatagaaaaaatcaattaaaagtaaacagaggcaaggggatagaacaatgaagtaatcctagactatcgtgaactcacctccctctacgttctgttgcctcattatctctcacctttcactgtctctcggttgcatgctgctgtctcagcttagttcttgatttcttcctgcccagataccttttatcagctctcctttcagttagcaataaacccacccactcatcctcctccagctgcctgctgtgcttagtaaaatgatggaagcacattccctgcttcgtatcttaggaggggactacgttacagttcagggcagtggaaacagttgtgtccactatatccagaatgccttgaggtcaagtttcagctctgctccttcgtaactgtggggccttggacaggttccttagggtctctagacatagctctcctgtgctttaaaatgcatattactacaatactttccatttacagttgttgagagaatcaactaatgtttttaagtgctcaaaatggtacctgcggcctacaaagcgtgtgattatgttagctcctctgtagagcacgcctggtctctacctacgtggcccacatggcaagcaatacaagtgctgctcttcacacaagtagggtgggagagagttgggaagcacaatgcttacacaaacaatctgcaagaaacatgccattagcttatctacttccacttaagggacaatttagaaagatatgcgtatcctggtagttggaaccgaactcagtcttgttgcaagaacagtttgaattcagcactttgaatatcaggtacaatttaataaaataaaagtagcaacttcctaaaaaatgatgactttcatccccatgacagggcctattccaggcaagaaattgcagtgatggaaggcaggcaagatactttttctgctttttgttttttttgtatttttctcctcttctccgtaagatattactttggaagctttcactgaggcactgagatacaacaggaaaaaatttaaaagcctgtacaaagatgcaaatttccaaaggacatttctgaacagaaaacttcatgactcttaaaaacatctcttcattgagttcaaagatttagttgtttttaaattttattcccaaaagggagataatatttggtgttacaaatcaaatttatttgacttggtaatgtatttaagggaagaacttagcaattaatagatctaaaatagcatattttaaagtttctatttatttattttacagattctggaaatagctcacacacacatcttacctattcttgttagtttgggccacatctgtttctgctttcaggtacattctaatacaggttgaatatcctttatccaaaatgtttgggaccacaagtgtttcagatttgcaatttttttcagattataaaatatttgcattcctctacaggcattttgcaggcctctttaacattttcaacaatatgtttacaccacatatcagagaatgagcaagaaacacagtgagtattgcccataggtcttgaccctatgtgggacatcttggagaaactgtcagtggcacatctggcctgcacacgtgccactttattatccttcatgggtgctttggtgggagaatctggacatgcaccaaaaagatatattgtagctgacagggtctagggggatattttttcctttggggactcagaatagactgtgttgtgtatttgtgttttgactgtgtttttaggtcaggtatggaattttcccctgacagtgttatagctcagaaaatttcaaattttggagcgtttcaaataccaggtgtttgaattaaagatgctcagcccatagtgtgaatgttttcagtggggcttctcttgtagagggatacattctgagactcatgtttagactttcaagggtgtcattgattacaagagctcggaagtctgtgttagtttgaagctatttggtcctgactatttttaaaatgcagtatatttactaagattgtttcttcaaatatctgttgaaatcaaagtaaaaaaataacaataaggtgttacttggcttttctctatttgttgcatgtacctctcataggtctggctcaatggtatgattagtaagggcagaatctgagtaatcttggatttttctgattatggattcaggatcagaagaggaaacaatgatatgtcatgtcattatcttcctaatgccagttaatgccatttcaacatcatagtttataaaatgtttacctgaacttatttatttccaggatattcagtatgcatattattataatagcttacatctaattccaagcatcatttcaagttttaatctttgtaattatcacccatttttaaggaaaaaacctagatactatctaaaaaagaacaatctctttattgaactattaatattaaaatgggataccccagttacattaattacctacatttaatttttattttaaatttaagtttaaatttaaatattgttttaatttcattgttatttgcttatttttttctctaattggaaaaatgagtagacttccatatacacatataaagcaaagcccaataagcaaaatatcatatttagttgatatttatatgcataattttacatttaccacgaataaagaaaaatcttgccaattatgtttttatgttaaccattgtaagactcaagctaatttcacagttgttaaaaatgtgaaagcatatgcagttgataaattaagagactactgcctgttataagcagggacaattatgaacaaattttagtctccagatcgctttcataaaatgtcttaatctaaacctagagtctctaaagtaagtaaaatacaatttaacactttgaaaataaacacacatacatgttattaaatcctattaaattatttgataaatgaagtgttcataaataaggatactcaaattttaaatatgacataatattttataaattattgaacttccattatttagtttagcaaatgttgcaaactaggtaatgttacagaaagtcactatcataaattaagtcaaaatgtaactgagtttaaatcaaccatgctctcttaagacctctaaaccaatcatatttaggctgaatgtcgaaagaactgcaaatgtctcctcagcttttataattcagggagatatgtctgggcttacatcctaacaattcctttccttcttcccgtgggaatgagacatttaagaacatttagagtaaggagtcatcatttattttaaattatccccttccattaatcacagtaatttcttcttttatctcctatacttgttcccaatacatcctatgtagcaacaacttagagttatataaaacatctagaccatggtaagtaacattagtaaggacttctaagtttaataattaattttgttccttcaagtaataagaaaatgttgaaaatttggtccttcctcaggacatgcttgaaaaacaaagcaatactagactcctacatatcaattaaaaatgtcaaataccacaataaaatactagaagataaacaaacaagtgaaactgtattgtaatgccatttaagaaaattgttgctagagatagatcaagtaagaaaacacacaaacagcccacccacaaaagcttacatttttgtgaatggcaagagaagaaaacagaaaatcaacgaacaagtaaatatacaatatgtcaagtgaaagatcccacgtggaaaggtaaagcagtttaagaagacagcaagaacagcgacagtgagtcgtcacataaaatgagcaggtgaggcctgtctgatgcagagacaaatgagcaaatatttgaaggaactaaaatagtaggatctatctatctatctatctatctatctatctatctatctatctatctatcatcttttatatatataaaataatatgtataaaataacatattatatataatttatacataaaataacatatatgggatatatatatgggataaaaatgtttttgaaaaaggaagtactttgcagacagaaaaatagcaggtgcaagtccctaatgtaagaatgtggttgttacaagggagaagtggcaaagccagtttgtgtgcagcagcaagaggagggagtgggaatgggtcagtgatggggagtggaagggcgagaggatactatggagccctggaggttatattcaggatattggatttgacttggagtcatgtaagatgccttgaaatatttttggtggatgagtgcaaagtctgatgaaatgttaaagaatgattttggttgttctgaaaacaatctaaaaattaaccctttaaaccctttaaactaatgcaaaattatacaacgagaggagttttttgtccatcaacgtggcagaataatttaaaatattgaaagcatgtgattgttaaaaagagtgaagaagacaaacatattggcatgggaatacattaaatatattttgagtacaaaatcaacacaaaaatatgtaaattattttatatgcctttaaacatacagaacattgtcggtaaggctacccactacagtggaccatcacaacatcttgaaaaaagagtaggaatgaagactgggtttagaattgttcttctgaaacatattgcctgaatagcaattaagaattttaacaccatgaattttgtatatcacccaggatttattatgaggaatttttaaataaattataatgtatgagtaaaacaaaaaagttatattttaattttttaggttcatattatataaagtttctataatagtataaatatattgactatataattggaaaatatattcaaaataaagtattatttagatgacatgtatatatatcagactccaaataaaaatttaccatttttaagaatgacaataataggaaaatatgaaaagtttaccttgtagtatccccctctcccccacccttccttacatacatgtgaacacttccacacctccaacagcagtacaaatgcatcgtccttttgaatgggatgtgaataccgacactgcagaaagtatcattaagtcaaagaaggtttatcttactttctgaattaactaatttttttgtcctacatataaaacattattttatgtatattaatatattcattaaaattttaacaaaaatatttataattattataataacacttgaatctatctcagttcatatcaacaagataaacaatagtttgttttttgttttgctttgtttgtgacggagtctctctctgtctcccaggctggagtgcagtggcgtgatctcagctcactgcaacctccacctcctgggttcaagccattctcctgcctcagcctccttagtagctaggattacagatgcatgtcaccatgcccggctaatttttgtatttctagtagagatgggttttaccatgttggtcaggctggtcttgaactcctgacctcatgatgcacccgcctcggcctcccaaagtgctgggattacaggcgtgagccaccgtacccggccaacaataatatttttaaagtcctttttcatgtgttctttcctctgcctgaaatgttctcccccaagattatctgcatgacttgcttcttattctttcaaatttctgctcaaatgtaacctcctcagattacaattctatctgaaatggtaccattcttcacattctatcccttctgtgtttatttattcttcgtagcatttaccaccaaaaagtctatctgtttatttgttgccttatagtcttaccctctcacattggaaagaagctccgttatttccagggatttatcttacttactcttatatctacagttttaaaaggcaggctgacatgtagtaggtattcaataaatgtattaggactgattgaaagaatgaatgaatttttaaagattttcaccaagataactggttgctttttgtttgtttatttgtttctttatctttgatatctttatttaagaaagtggataacccttatacttcacttcctataaaacagagaatttataactcagagttgagtctattagttgctaattaaacagaaatacgatgtcaagaacttataaatttgaacatttcaacttgagaaagaatgaggatagaattcttaataaataattggttggattctcaggccaggtctttccttgatacgtcccatgtctagtagtagctattggcttgtatctccctgtttttaaatctaaaagaaaaaggaatgttctatcttattattactaaaaaatctgaaattattgcttgcaaggcctcatttgtctgtataaatcaataactcaagggaaggggatacgctactgtaaaaggacctagatcatgcgcacactgctagtgagaataaactccatccaagacatagacatggagttagagttgggtgataaatcaagattcggttatcataacaaggggaatatggatggtcaactgaagaaacaaaaagaagtataacaattttccacaatacttaagaaaatcattggctacaataaatgcataaaactgttggcaatgtatctccttccattaccaatcagtcttgctatgaaatcttgatatattattgctagtaataaaagttttgatatattggttctgaagtgataagcctaggcaatttcaaatactgaatacatttatatgagaagatacttgagcaaggctatttgaattaatagatatggccattactcatatgaacattatcataaagattattttttaaaatcaccaatctcattacaaaacttattttacacgttaatcccttgttaagagctgtgcacttcagtgtgcaaagctagttttgtattgctgacgattaagtccagagaatattaaaaggatgaatacccagtggtgacttttacggattttgcaacgctaaataaaaattagcaggtcttgctcctttgcaatgagtaaaatatgtgttattaggtattcaaagtaaaagttatttatttgctaaaatgcacggtttttttctacttaacattgtactaaaagttctagccaggacaattcagcaagaaaaagaaataaaagacttctgaattggaaaggaggaagtaaaaatatctttatttaaaaatgacatgatctgtatacggaaaatcataaagaatacacatatgcatacacacacataactattagcactaataatcaatttcagcaatgttgcagaataaaagatcaatctacaaaattcacttgtctttctgaacaatagcaataaataattccaagatcaaagtcagagaataatttcattcacaatagcatcaaaaagaataaaacattcaggaataattttaacaaaaatttgaagaggaagtctgaaaatcacaaatatcattgaaaaaattaaagaaaatagagagatatccccacattcgtatctcaaaaaatttatagtagaaatatatccccacattcacactcctgcatttaatgtaaggcttgatattattcagctgtaaatattcttcatattgatctacacattcaatgaaatccctataaattccagcctttttttttttgcagaaattgacaagctgattgtaaaattcatatgaaaatttaaggaactcaaaatagcattaaaaaaaatcttgaagtacaaaaacaaactttgaggaatcacacttcttggtttcaaaacttactagaaagctacaatattcaagatgatatgatactgatttaaggctagaaaggtagattaaagaaatagaattgagactccagaatcagtctttacattatggttaacaatttttgaaaaggacgccaatctaattcagtggcaaaagaatagactatgcaaaaaataatggtaggaaaactagatagtcacatgcaaaagaagttggaaccttaaataatttaccaaaatttatttaaaatggatcagatatctaaatgtaagcattaaaactacaaaatttttagaagaaaacataggagtaaaccttcataaccttgaattaggaaatggttcttagccacaacactgaaagcacaaacaataaaagaaataataggtaaattggatttcatcagaatccaatatctatggatttcaaaggataccattaacaaggacagcccacagaatgaaagaaaatacttgaaaatcatatatctgataaatgacttgtattcagaatatataaagaacacttacaacaataaaaagacaaatgaccataactcaattaaaataaacaaataatttgaatagacatttcaccaaacacacacaaacacacacacacacacacacacgatcaattagaacacagaaagatgtatggtgtaattagtcattagggagatacaaatcaaaatcacaatgaggttttacttcataagcattaagatagctaaaatcaaaaagaaaaattcacatacatttgaaagagtaaggagaaattacatgcagccattttgcaaaatagtttgtcattttcccaaaatatcaaaaataaagttgtactatttattacccagcaatttcactcctaagtatttatatctaagagaatttgcaattttctaattaaaatgctgaacatcttttatatgactgttttttaatttgtaggtctttttaagggtggtgttgattcagaactcttgttttttgtttttaatttggctattcacttccttcttgttaagttttaagaatttttagtttattttggatccaaattctttaccagatatgtcttttgcaaatattttctccaagttcatggctttttttttttttttttttttttgagacggagtctcgctctgtcgcccaggctggactgcagtggcgcgatctcggctcactgcaagctccgcctcccgggttcacgccattctcctggctcagcctcccgagtagctgggattacaggcgcccgccacctcgtctggctaatttttttgtatttttagtagagacggggtttcacagtgttagccaggctggtctcgatctcctgacctcgtgatccgcccgcctcggccgcccaaagtgctgggattacaggcgtgagccaccatgcccggccgtccatggcttgttttttatcctcctgctagtgtttttttacaaggccatgtttttaaaattttagtaaagtccaatattgtaatttttgcccatgaattatgctatttttatatttgaaaactcacctgcaaagccaaggccaggtagattttcttctctgtttatttcatgatgttttatattttttcattttaggatgtattttaaactgatttttgtgtaagttcgatttcattggtgcattttctctctctctctctctctatatatatatccaattattccagtactgtgtgttaaaaatccttctatttctctattgaattgcccttgctcttttgtgaaagaccagttgactacatttatgttggtctgtttcaatttctgtattctcttcaatgatctttttcttttccagtatcacactgtcttgataactgtagccttatagtaattcttgaaattggctaccttaaatcttccaaattagctcttttttagtattgtgctggctacactaggtctttctaccttgagattgagtcgaatctacgtatcaagttaagagaattggcatcttaataatatggagtctttcaatatatggatatgaactctctatttatagaaatctctgcttcttttttaaatcagagttttaagttttcacatatagctcttgtatatattttgctagacttattatacctaagtgtttcatttgggggtattaatataaatggtatttcttattttaaataccaattgtcaattgctgacagaaagcaatgggcatttgtatgttttaccttgtgttctacaaccttgttatacttgtttatgagttccatgagttaccctgttaattcttagggcttttgtaaagtagataaatctcatctttgaaaggaaacatattaatatcttccttctcaattggtatgccatttatttcagtgggtggggtggggtgctcagaatgtccagtatattgttgagtagacgtagtgagagaaatcatcctccttttttcctaatctatactgggaaagtgttcattgtctaaccataaaaatgaagttagttcatttttgtagatttttaagaatcaagttgaagaactttttttattttcctttaactaagaaattttaacatacatgggcattagatgttgtcaatttcttttgcatcaattactataatcatatgacctttttttaatccttgatgtgaattacattgattgattttaatatattgaaacatttctgtatacctagaataaatccctcttggccatggtgtatacttatttttatacattgttggatttgatttctaatatttccttgagtatttttgctttcatgttcacgagagatattagcctgtagttttcctttcttgtgaagtcttcatctgttttgatgttaggataacactggactaacagaatacgttatagagtattttctctgctcctagttactgggagtgatttcttaaaattaagctcattttctccttaaatggttggttgaattcagctgtgtttctctaatagctacatgactattcaggttgtctatgtctccttgtcaaagttctggttgtttgcgtattttaagaaattagttcatttcttctatcagatttgtggacataaaaatattgttcattatatttctattttatcctactcaatgctcatactatatgtagtgatgatcccccttttacttgtgatcttggtaatttatatatatatattttttcttatttagcctacatagaggattgtcaatatccttagattaaaaaaaaaaacaagtattgtttttgttaattttctctattgtcttgttttttgtctcattaatttctgctaattgtgaattatttcttttcttttgcttgctttaagcttaaattagacttctttctttgtttaccaaactggaagcttcagttactaatttttgagcttttctattttctaacataggcatttaatgtgatacatttccttttaagcactgctttttgttgcatgcaatatttttatgggttagatttttatttagttcaaaaatatttaaacatttttcttagtacttctttgacttttgttttactgagaagtgtatctttaaaatatctgaagattttccaggtatctttcagtttttgattttaactttgagtgctttgtattctaagaatgtttattgttcgatttctcatactttaatttttttacatgtagttcatggcactgaatgttgtctgtcctggtaaatgtttcttgtaaacttgagaagaataggtattcttttgtttatggattaagtatttctagaatacttaattagatcaagttgattgataatgttgctcaggacaattacttctttccagattttctggctttttgatttgtaaattacaagctgttgttgaagtctctatgttctgtattgaatttgtctctttctcctgctactgttgtcagtgtttacccctggttgtttgatgattttttgttagaaccgtatctgtttgtgttaggtattcttaaagaatagactcctttactctttatcactgataatttcccttctgatgtctgctttttctgaaattaatatagttactgttactttcttttgattagtgctatcatatctttatcaaacactttatttttcattgtaccagaatatttatatttaaagtgggttttgtagataacatatagctgtgtgatgtggaatgtttttgtatcattctgacaatttttctgtaattgatgaattacaatctttcacatttaaaatgattattgatatatttagattaatgttaatcatttttgtaattgtttctattcattgttctgaatttcttttttcttttttttagacagagtttcactcttgctggccaggctagagtgcaatggcgcgatctcggctcactgcaacctctgcctcacaggtacaagcagttctcctgcctcagcctcccgagtagctgggattacagggatgcaccaccacacccagctaattttgtatttttgtagagatggggtttttccatgttggtcaggctggtctcaaactctggacctcaggtgatccgcctgcctcagcctcccaaagtgctggtgagtcactgtgccagttacgacttccttttctatcttctttttttaattgagcattttataattccatcttatctcccctctaagtgtttccattatatctccttcaaaaaagttgtcactgtttgcctagagtttatccatacaatctacattttttaagtaaaatttttcccatctattgagcgtatactctgtgacacttattggatgattatgtgcgacatctctaagttgagcaatgggctttcactaacatgccaactttccaggattccaaggaaacatccttgtataaaaaaaaaattgtttcttagagaagctcagcgatatgcccaagacctacagttctcaagttgtagaactgcaattctaacccactgagctcttttcaccactcaggattatagtagtttggaattgctctgtatcacatacttatcattactaaaatatatgtttgatgctataaatgtccacttaatttcaaaatctgaaatccgtattgctgagctctcttctcagagaacagcagtgcacagtgattagcacaatgaactccaaagctggggagtctcttttccaatctcagctctgccacttaaagctggggagtctcttttccaatctcagctctgccacttactttgggtatagcctggggtagtgtcttaaattttctttggttctgtttctttatctctaggatggcgcagataatagtaacacttatattaaggggcctctgtgagcctgcatgatgcccttaggacaactcctggtgaacagttaagcactcagaaaatgagaccatttagcaattctcaggggattgagcattctctgtatttgagcattctcctgggccttggtttatctcaatatattctcatgttttttatttatacattgaacaaaggcttactcagaccttccaggtggttgctgcagtgcattcattggtgatatgcacaccaataaacacataacatagcgcacggaagaacggcatgaccaacatttgctcagctctttacagtttacaaggacatgtagtatttacagtgctaactgtcacatgctattttagactcacatacgtaagcttgaaatgcttcagtggccaaatccaagttgagaatgttggaaatagtgtaacaagaggcaaaccaaatgggttgtttgcctcctttcttttcctaatgtttttattgatgtaaaatacacatagcataaaattttccatcttaaccatttttaagtaaagaatgtagtggtattaaatacattcataatatacagccatcactgcaatccctctccataacttttttcatgttataaactgaaactctctacccattaaacaataattcctcattatccccttctccaagtcattggcaaccactgttctgccttctgtctctatgattttgactacctcatacaagtggattcagacagtatttgtctttttctgactgacttatttcatataacaatgtcttcaaggtttatccttcttatagcttatatcaaaacttcctactgcttgaggactaagctcagatttttttatcttaccaaattcctgcctaaggggtttagggagtcatgccctacaaaccataaattctcatcagatgggttttatttgaccctatatattgtgacttacttttcagtctgacactggcataacattatgagacaagggaaaaatattttaccccaaaatatatttccttgccatactttgaaattgctctgcaaagtctcttgtgggaaaaattcacattctatagaaaatccgcttccccttttgttttccttcctttctttccaaatccaggagataatcaagtaagagccaggcacccttttaagtctgagtaagaaacaatttaaaaactgctctctctgaagtcagctgagagcttcctctgcacgataaaacttggtctccacaatcctttatctttaacctgaacattcctttctatccctatggatcccatgtctttagacaaactcaaccaatcgtcaaccagaaaatgtttaaatttacctatagcctggaacccccacccctgcccccctgtagctttgaattgtcccacctttctgaaccaaatcaatgtatttcttaaatctatttgattgacatctcatgcctccctaaaatatataaagccaaattgcaccccaaccaccttggacacatgttctcaggacctactaagggctgtgtcatgggccatggtccttcatatttgactcagaataaatctcttaaaatattttaccaagtttcactctttttgtcaacagctttaaggctgaaaaatattctgttgtttgtatgtttcatgcgcgtccgtgtaaagagaccaccaaacaggctttgtgtgagcaacatggctgtttatttcacctgggtgcaggtaggctgagtccgaaaacagagtcagcaaagggagataagggtggggccgttttataggatttgggtaggtaaaggaaaattacagtcaaagggggtttgttctctggagggcaggagtggaggttgcaaggtgctcagtgggggtgatttttgagccaggatgagccaggaaaaggactttcacaaggtaatgtcatcacttaaggcaaggaccggccatttacacttcttttgtggtggaatgtcatcagttaaggtggggcagggcatattcacttcttttgtgattcttcagttacttcaggccatctgggcatatatgtgcaagtcacaggggatgcgatggcttggcttgggctcagaggcctgacattcctgccttcttatattaataagaaaaacaaaacaaaatagtgttgaagtgttggggcggcgaaaatttttggggggtggtatcgagagagagaatggtcgatgtttctcagggctgcttcaagcgggattaggggcggcgtgggaccctagagtgggagagattaagctgaagggaggtcttgcggtaaggggtgatattgtggggatgttagaagaaacatttgttgtatagaatgattggtgatggcctggatacggttttgtatgaattgaaaaactaaatggaataacagaaggagaaaaacaggtataaaaggtctaagaattgggaccacttaggatatctgattagagagtgcttaaggagattcggcatagtcctgccagcaaagatcaaagagaggctgggacgaggggtgcaggggaatagtggaaaaaggcatctttaagatcaagcacggaatagtgagttgtggaggagggtattgaggacaaaagagtgtacgggttgggcaccacagggtggataggcaaaacaatttggttgataaggcgcagatcctgaactaacttgtaaggcttgtctggttttaagacaggtgaaatgggggaattgtaaggagagtttataggctttaaaaggcaattttgtagcaggcgagtgataacaggctttaatctttttaaagcgtgctgctggatgggatattggcgttgagtggggtaagggtgattaggttttaatgagatggtaaggggtgcatgatcggtcgccaaggagggagtagaggtatcttatacttgtgggttaaggtggggggatacaagaggaggatgcaaaggaggctttggattgggaagaagggtggcaatgagatatagctgtagtccaggaatagtcagggaagcagatgatttaaagtgtctcagcctaataagggaactgggcagctggggataactaaaaggagtgcttaaaagagtactgtctaagttggcaccagagttggggagttttaagaggtttagaagcctggccgtcaatacccacaacagttatggaggcaagggaaacgggcccttgaaaagaaggtaatgtggagtgggtagcctccgtattgattaagaaggggatgggcttaccttccactgtgagagttacctgaagcttggcgtccgtgatggtctagggggcttccgaggcgatcaggcagcatcagtcttcagccactaagccaagaagatctgggaaggagtcagtcagagagcctcgggccagagttccaggggctctggcagtggctgtcaggtgagctgaacagtccgatttccagtggggtcccgcacagatgggacacggcttaggaggaatcctgggctgcaggcattccttggcctggtggtcagatttctggcacttgtagcaagctcctgggggaggaggttctgaaggaacacctggcctctgcggttcaggcgtttggaagttcttgtatgctagagatgtggctagggtttgtctcacagtggaggcgaggaattgcaacttttttttttattattgtacaccttgaaggagaggttaattaagtcctgttgtggggtttgaaggccagattctaatttttggagttttatttaatgtccggggcagattgggtaataaaatgtatattgagaataagacggccttttgacattttaccgtctagggctgtaaagcatctcagggttgctgccgaacgagccatgaactgggctgggtttttatatttgataaaaaagagcctaaatgcttctgatttgggataaagaaaaaggagcattaaccttgactatgcctttggctccagccacctttttaagagtaaattgtgggcaggtgggggagggctagtcagagaatgaaactgtaagccggaccaggtgtgaggaggggaggcgataaaaagattacagggtggaggagcagaggctgaggaagaattgggacctagcttggcctggcaaggaggggagaggtcagatgggtctgtagaaaaggaagattagaaagactcagctacgcttggggttgggactgaggggacaggtgggagggaaagaaggaagatttgggacgagttgcactgggcacagagactaggaagggactgatgtgtaaaagaatgcctggacatcaggcacctcagaccatttgtcaattttaggacaagaattatttagatcttgtaggatggaaaaattgaaagtgccattttccggctatttggaactactgtcgagtttgtattggggtcaagcggcattgcagaagaaaataagatgcttagattttaggtcagatgagagttgaagaggttttaagttcttaagaatataggctaagggagaagaaggaggaatggaaggtggaagcttgcccatagtaaaggaggcaagcccagagaaaagagcagagacacggagaaggggtggggggttcttgccctccagaaaagcagagaaagggttggggcatggaaataaggaattggggcacagagataagagggtggggcacagaaataagggattgggtgttcttgccccctagaaaagcgggacttgccgctaagggtgaaggagaaggggttgaggggtacttgcccctcccccagaaaagcagagaaggggtagagacaaggagagaaggggttggggtacttgccccttcctcagaaaagcgggacttgccactaagggtgaaggaccaaggcaggtgtccctgcttggtctgacacctttgaaatgtgtgtgaataatcagagaggtgtccctgcaaggattaaataccaagggaaggctgccttcccagtccgtgaccgccgccggagttttgggtccacggataaaacgtgtctcctttgtctctaccagaaaatgaaaggaattgaaattaagagaagggagtgattgaagtgtggcgccaagattgaaaggagaaagaggttgaaggatagtgagggaagctggagaagagagtaaaaagaggccgcttaccggatttgaaattggtgagatgtttcttgggctggtcggtctgaggacctgaggtcgtaggtggatctttctcacagagcaaagagcaggaggacaggggattgatctcctaagggaggtcccccgatctgagtcacgacaccaaatttcatgcgcgtccctgtgaagagaccaccaaacaggctttgtgtgagcaacaaggctgtttatttcacctgggtgcaggcgggctgagtccaaagagagtcagcaaagggagataggggtggggccgttttataggatttgggtaggtaaaggaaaattacagtcaaagggggtttgttctttggcgggcaggagtgggggtcgcaaggtactcagtgggggagctttttgagccaggatgagccaggaaaaggactttcacaaggtaatgtcatcacttaaggcaaggaccggccatttacacttcttttgtggtggaatatcatcagttaaggtggggcagggcatattcacttcttttgtgattcttcagttactttgggccatctgggcgtatacatgcaagtcacaggggatgcgatggcttggcttgggctcagaggcctgacagtatgcaccatattttgtttatccattcatttaccaactgatatttggcttgctcctacattttagctatggtgaataatgcttctatcaaacatggttgtacgaatatatcttaaataccttctgttcaattattttagatatataccgagaagcagtattgctggaacatatggtaacgaaatttttaaatgcttactttttgaggaactgccatactgttttccacagtggcataaccacttgacattctctctgctacaggaaagaggtcctgatccagacaccaagtgaaggttcttggacctggcttaagaaagaattcagggtgagtccataaagtgaaagcaagtttagtaaaggaaggccgggcgctgtggctcatgcctgtaatcctagcactttgagaggccaaggagggtggttcatgaggtcaggagatcgagaccatcctggctaacagggtgaaacgccatctctactaaaaatacaaaaaattagccgtgcgtggtggcgggcgcctgtagtcccagctgctcgggaggctgaggcaagagaatagtgtgaacccaggaggcggggcttgcagtgagccaagatcgcgccactgcactccagcctgggcaacagggcaaggctctgtctcaaaacaaaaccacaaaaacaaacaaacaataaaaaaagaaaaaagaaaaaaaagaataaaagaatggctcttccatagacagagcagccccgggggctgctggttgccatttttatggttatttcttgatgatatgctaaacaagggttggattattcatgccttctctttttagaccataaagcaacttcctatcatttcaatggcgtttgtaaactgtgtggatgaccagagatcactcttgtcaccatcttgattttggtgggttttagccagcttctttgctgcaacctgttttatcagcaagatctttatgacctgtatcttgtgccaacctcctatctcatcctgtgacttagatgccttaaccctctgggaatgcagcccagtagatcacagtcttattcaagatagagttgctctggttcacacacctctgacatcaacaacagagtataagggttccaatttttccacatctttgccaccacttgttattttctgtttctgtttgtttgtttgttttgtgagactgggtctctctctgtcaccctgtctggagtgcaatggcatgatctcggctctctgcaaactttgcctcatgggttcaaggaattctcctgcctcagcctcctgagtaggtgggattacaagtgcccaccaccacgttcagctaatttttgtatttttagtagagatagggtttcaccctgttgaccaggctggtcttgaactcctgacttcaggtgatcagcctgctttggcctcccaaagtgctgggtattttttttttttaaatagtagccatcctaatgggtgcaaagtggcatctcattataattttgatttgcatttccctaatgattagtgagtttgagcttttcatgtgcttattggcgatttgaatatctcctttggagatgtgtttatgcaagtccttcaccagtttttgaattgggtttgctttttgtttttgttgagatttatgaattctctacatattgtggatattaatcacttattagacacaaaacttgaaaatgttttctcccgctctgtgggttgcttttttactttgatgatacaggtttttaatgcacattttaaaaaaaacttaatgacataccatttgtctactttttttgttgtctatgcctttgttgtcacatgtaaaaaaaaaaaaaaaaaaaaaaaaaaaaaaaaaaaacttggccaaatcagttgtcctgaagagttgctctattttctcctaagtgatttctagtgttaggttttagatttaagtctttaatccattgtacattaatttttgtttacagtattaagtgagaatccaacttcattcttttgcatatgaacatcctgtttcctaacagcatgtgtttaaaagactgtcctttcccaaaagaattgtactgacacacttgtcaaaaatgatttgaccatatatgtgagggtttatgtctgtaatctctattttattaaattgatctatatatttctctttatgccagtgccacatggtttgttaatattgctttgtagtaagtttgtggcaagtatgagtcctccacttttattttctttttcaagattatttggtattttgggatccctttagattccatataaattttacgactttaaaaaaatattttcaaaaagcgttattgggattttgatagggatcgcattaaatctgtagattgctttgcatagtattggcatcttaacagttgtatctcttctgatccatgagcattgaatgtgttttcatatatttatctcttattcaatttcttccataaatgttttctagttttcattgaagaagtctttcacttcgttggttaatttttgagtattttattctttgatgctattgtatataaatctattttcataatttatttttcaagttactcattgttagtgtatagatatgtcaattattgttgtgttaactttgtatcctgctctgctgaattcatttattagttcaaacggtttttgtgtgaaatctttaggaatttctaaatataagattatatcatctgcaaacaaacttaattttattttttccaatttagatgccttttattttttttccttgctgagttgccctgactagaacttccaatactatcttgaatgtcagtggcaaaatcaggaattcatgagtatagaggaaaagctttcagtcttgcaccatttagtatgatgtttgctatgagtttttcacgtgcagcatttattacattgaggtagtttccatttattcctagcttgttgagtgcttttgtcatgaagtggtgttaaattttgtcaaatgctttttctgcatcgattgagataattatgtgggtttttccatcattctagtaatgtagtgtattgcattgatgaatttgtatgctgaaacatctttgcattacagaaataaaccccacttggtcatagtgtaaaatcctttaatatgctggtgaattcagtttgctagtattttgttaaggactttttttttttttttttgcatcactgtttgtaaggaatattggtctgtggctttctttcttgctgtgtctttgtctgccttcaatatcaagataatgcagacctcatcaaatcagtttggatgtcttccttcttcaagtttgagaattattgatgctagttttttaaatgtttggcagaattactctgtaaagccatcatgtccagggcttttctttgtgatgaggttttgaataccgactcatttttttcttctttttatagatttattggggctttctattcatcttaataggttttgtgtttctagaaatttgtcctcttcatccaggttattcaatttgttggtataagttattcatagcatattatcataattctttttatttctgtatgatagatagtaatattccaattttcatttctaattttagtaatttcactcatctcactctgtgtctcttttttaaaaaaatgtaattaattaattaattaattttagtccatctggctaaatgttcgcccaatagttgctattttcaaggaaccaactgtggtttcagtgatattctcaattttttttaattttctattttgctttgtcagctgtaatatatattatttcctttcttccaagagccttgggattagattgttctttttctagtctcttaagttgtaaagctaaattgttaatttgacgtctttgttgttttttaatgtaaccatttacatctccatttttttcccttaacactgtctttgcagcagcctttaaattttgatataatgtgttttttgttttcattcatctctaagtattttttaatttcccttgttatttcttctttgatagtttaagaatatgttgtgtgatttctgttaatacaaattggtgaattctccagttttactttgactaatgatttttaacatagttttgaggtcaaagatgaagccgtgtatgttacctctcttttaaaatgtgttgagacttaatatgtggctctccatatggtttgtcctggaaaatgtctcatgagcattcaggaaagcgaaacgtgtatgttcagtctgtgtccttcagatcttgacagttcattgtgttaagtcctctattttcttacttctctctggttgttctatctattatcgacagtggggtatcaagttgccaactactgctgtagaactgtctatttcttcctttagttctatcatttttcattttgtatatttagatgctctctcattaagtgcctaaggttttattattgttgttacttgttgtattgaaccctttattaacatataatatacttctttgtcttttgtaaccattttttgcttttgacaaagtcagtgtgttttatttgatattggtatagttaccctgctctcttttggttagtaataatataacacactgaaacctccacctcctgggctcaaaaaattctcatgcctcagctatccaagtagctggcattacaggtgtgcgccaccaccccaagttaatgtaatgtaatacctttttctatccttttgcattgaatcattgtgtctttagatctaaagtgagtcttatagacagcatatagttgcatcatattatgttatccattctgctagtctcactttgtcacccaggctggacaggtgtgtagtggcacaatctcagctcattgcaatctctgccccgcaggttcaagaaattcttttgcctcagcttcccgagtagctgggattatagtcatgcaccactacacctggttaatttttgcatttttagtagagacggggtttcaccatgttggccaggctggtttcaaactcctgacctcaagtgataaacctgcctcggcctcccaaagtgctgggattacaggtgtgagccactgcacccaaactctttctcatttccttttcctgaatatactgtataactattttatttgtgcttacgatttacaaatttgtgaatatatttaacattctagagttatcactctatctcaaatgtatacaagcttaacttcaatgacatacaacaactttggtcttttgtctggtctgctctgtcccccaccttttcagttgttgatgtcacccaaaacataaactaagaatagttttaaatgcataagtcacttaaattatgtagaaaacaaaatatggagttaaaatttataatcctactagaatttaaagtacttatttttttaaagtattcattttttttttaaatcttttattttgagacagagtctcactatgttgcccaggctggagtgaagtggcatgatatcggctcactgcaacctctgcctcctaggtcaagcaattatcgtgccatggcctcctaagtagctgggattacaggcacccgccaccacgcccagctaatttttgcatttttagtagaaatggggttttgccatgttgcccaggctcgtcactaacccccttctcaagtgacctgcctgccccagcctcccaaaatgctgggattatgggtgtgagccactgcacccatctgtatcagtcttttaaatcatgtagaaaacaagaagtgatgttacaaactattgttaaaataatgttgcttttatatttgcccatgtatttacctctattgaaattttttacttctttttatggcttctagtcactttctagtgtcctttaattttatcctgcaggactctcttaagcattcctctcggggaaggcctggtagtaacaaatggcctcagcttttgcttatctggaaatgtcttaatatcttttttacctatgaagggcacagtttttcattcatacatcataattgtacattttttatgggatacatgtgatattttgatacatgcattcaaagtattgtgataaaacctgggtatttaggatatctatcatctcaaacatttattatttctttgtgtttacagcattccaaatcttctcttccagctattttaaaatacacaagaaattattgttaacttttgtcaccctactgtgctgttgaacacttttctaactgtatttttggacccattaaacaattctctttattactcctccttcctattctttgcaactgctggtaaccatcattatactctctaccttcgtgagataatttttttttaattcccacatatgaatgagaacatgcgatattcatctttcaatgcctggcttatttcatttacataatgcccaccagttctatgttgctacaaataacagcatttctgtcttttctacggctgaataatatttcattttatatatataaaaaaaaaatttctttattcattcaactgttgatgaacacaagcggcttccacatcttggctattataaatagtgctgtaataaacatggaagtacagatgtctctctaatatactgatttcctttcttttggatatatacccagcagttagactgttgaattttatggtgattaattttttttaatttttgaggaagcttcatgctattttccattgtggtgtactaatttacaatcccaccaatgacatatgagcattcttttttctcttcattcttgccaacatttcttattttctgttgttttgataatagctattctaactgggattacatgatatgtcattaaggttttgatttgcatgtccctaatgattagtaatgttgaatattgtttaatatatcttttgtccatttgcatgtcttcttttgtaaaatgtattttcaggtaatttgtgcattttaaagtttttttaaatttttatttatttatttaattttttgctgttgagttgtttgagttccttgtatattctggttatgaagcctttgtcagatagataatttgcaaactttttgtcccactctgtagattgtctcttcatcctgttgattgcttcctttgttgtgtagaaactttttagcttgaagtaatcccatttgcctatttttgctattgttgcttatgcttttcaggtgttataaaaaatatttgcccatactaatgttttgaaatgtttccccaaagtttccctctagtagtttcccatttgcaagacttacacttaggtctttaatccattttctatttggtttttgtatatagcaagaactaggagtctagtttcttttgcatatgctagcactatttattgaagagactgttctttccccaatatatgttctgggaacctttgtcacaaatgagttggcagtaagtgtgtgtatttatttctgaattaactgttctgttccattggtctgtatgtctacttttatgccaataacatgctgttttagttactatagctttgtagtatactttgaagtctgataagctgatgcctctaactttgttcttcctcaggattgatttggccatttgatgacttttgtaattccatacaaattttagagttacttattttatttatgtgaaaaatgccattggcattttaatagggtcttcactcaatctgtaaatcactttgggttgtgtggacatttcaacaatattaattctttcactccatgagcataagatatttttctattttttaatttcccttttaatttctttcatcagtgcttaatagtttttcttgcacagatctttcacttcttttattaatttttttcttaggtattttattattttcaatagctattgtaaacgagattgctttcttgatttatttttcagattctttactgttggtgtatagaaatgtgattgatgtttgtatttctttactatctgcaactttactaaattcgtttatcagtctttaggtttttctaaatgtaggatcatgttgcctgtgaacaaggctaatatgacttctttctttccaattttgatgttctttttcttccccctagcccaagtgctctggctagaacatccaataatatgttgaataaaagtagtgaaagtgggcatccttgtcttctttcagatcccagcagaaaggctttcaatttttccctgtctagtatgatgttagctgtgggtttgtcatatgtggttttattgttttaaggtatgttcctactatacttagtatactgggagtttttatcataaatagatattgaattttattaaatgtacatgattgtgttcatgttatccatcacatttattggttttgggtatgttgaactattcttccatcattggaatgaatcccactttatcctgatgaataaacttttaatgtattggtgcattctgtttgttaatattttattgataatttttgcttttatgttcatcagtgatattgggttgtttttctgttgtgttcttgtctggttttggtatcatggcaaatctggcctcatagaatgagtttagaaatattctctcccctgaaattttctgaaatagtttcagtataattaacaccagatattctctaaatatttggtagagtttagcagtcacctctggtctttttatataagactttttattactgcttcaatgttgttactctttattagtccgctcagattttctgtttcctcatgattcaatcttgataggtcatatgtgttcaggaatttattttttctaggctttcaaatttgttggcatatagtcgttcataatagactctaatagtcctttgcatttctatagtatcagttgtaatgtctcttttttcttatttagttccagctaaaggtttgtttattttgtttattttttttcaaataccaactttttgatttgatggggtttttttttttattttttagcctcaattttatttatttcttctataatatttgtttctttcagtcttattcattttgagtttagttggtttttgctgttctggttcctttgggtgtatcattaggttgtttatgtgaagtctttctacttttttgatgtgcgtatttatttctataaactttccttttagaactgcttttgctgtatcctatatgtttggatacgctgtgtttcgatttttatttttctcaacaagtttctaatttcttcattgacctaattattgttcagtaacatattatttaatttaatttctatggatttgtaccgtttccaatgttccttctgttactggtttccagttttattttgttgtggtcagaaaagatgtttgatattattttaatttaaaaaaattgttaagacttatcttgtgacctaacatatggtttattctggaaaatgtcctatgtgctattgagaaaaacatgtattctgtagttgttggatggaatatttataaaagtctattaggtccatttgatctacagagaagtttaactccaatgtttcttcattgatttgctgtctgaattatctgtctatgactgacagtgggatgttgagttttatactcttgctatattgacccctttattattctattatgcccttcttttacttttaactgttcttcacttaaagtctattttgtctgatataaatatagctggttctactcttttttccctcctttcatattcagtctgtgcatgtctttagaggtgaagtgagtactttaggcagcgtatagatgggtcttgtctttttatctattcaatcactctatgtcttttaataggataatttaattcatttacattcaaggttattatgggtagattaagtgttactactgccattttcctccctgttttctggttgctttataattctttctttcttcctttcttattgtcttcctttgtgattaagtgattttttttctagtggtactttttgattctgtgctatttattttaggtctatctattgtaggtttctgttttgtggttaccatgaagtttacaaaaaaaaccttacagttataacacattatattaaactgataacttcttaacttttatggcaaagaaaagttacataaagtctaccttaattttctgtagtctgaatattgtttgtctaggtatagttatttgtttgtgtgtttgtgttttaattgtagttgtttcttagctttctgtaactgtgatttggtctgttattacctttgaattgttctctgacattgttacttcaaatatttcttccttttcatttcctctttcttatttttctggcatcctaactaggtgcatgttatgtcttttggaaattttttacaggtcttggatgatctcttctgcatttttttacctctgcgttttaaaatgagaagtttttattgatttatcttaagctcggtgatgctttcctcagcagtgtcacatgtacttgtgagtccatccagtcattcttcactattattataatgtttttcatttccaatatttatttgtgattcttttttagaactttcatctctcttcttatattacctatctgttcttacatgttgcctactttaatcactagagtccttaacatatcatcacagttattgcaaattccctacttggtaatttcaacattggtgtcatatctgagtctggttctgatgcttgctttgcatcttcatacttttttgcccttgattttctgtatttattgtaattttttgttgaaagttgaacatgtggtattggataagagtaaccgaaaaaaaatcctctactgtgagaaattgcatgtatttgaataggagcctgaatttttttaatgattaccatagctacagatgcctgatacttcaaatccctacagtgtccttgtttaatctcccctcttgactttgggtttctctatggacatcttctcagacagagtatacatcttgcaggtcctttgcctacaatccaatatcattacagtgaaactctattggtgttgtggtagagtatggaatgaaggaggaacattctataatcttatgattaagtctcatttagtgagtttgtgtctttggcctctgaactttgcagctgttcttcttatgttgttttgcttccctcccagttaggtaagacaagaagcctgtagaggcctggagtgggaaaaatgctttttatgcagctgtgtaaggctctggtaaagaactggagaggaggcttttgttaatggagaaggctctgggcatattccagaagaatcgctccccccacacccacccacttgtcaaagccatgagaagatctttcttagatcctcacaagaagtaactggtggggctcctggaagtaaaacccatgctagttggtagttgagcatgagattattcgttctcatgctagatcacactcaaccaccagcagttaaccaaattactaggtaagtgttcctactagaatggctgtagcagctactaccttcaggcagcagaccttgcatgtaactatctggattttcctttccaggtttactgggaatgtacatatgtgctttttgagtgttattttctgagtgttatgattaacttccctttttgagttagtgacaagaacatattctttgatagtttattttttcctttgtaatgacaaacacataaggaaaacttgatgcttaactagggattatctgaaataagtgcactttgctttgagtaacactaattaattaatgttttatactaatgttaaacattaaatatgtttttatacgaatcatgtaattaagattaaaatcccaatgagtatattaaacaattatgttggaaaaatttgaacttctttctctaggatagcagagtgcagtaattttaataaatcatatgcttgtgtgtttatatgctcatgtatacacagccctacatagtacaaatgtaaatttgtcttcaaactaaaatctctatttaccacactttagggaaatatttttatcaaatttaattatttaattttttagatctttactctggaaaagacatataaaagaaacactgagaagtagcctcattttctttttagtaactacctgattaattttataaatttatgaaaattagcattagtacacattttagtaacaggaaataagtatactatttgactcaaataggatttgcaggtaaaaatacagacttattaatgaaaacctgttcttatctaattttaagtaatctgttggttggataaatttgattttcagaaaccttgaccttgttgataatgggtagtgagcagattttagatcatgtagttagttttgcatgtattacacacccatctgcttctccatctggcagcagacacagaagtgttatgtacattcttctcaccaacaccccaattgttagcttcctgctgatagccccagtataagcttcattgggtaattatttcaggcagaaaacaaccaacccacatgttcaagaataattactagttcaattaactaaccaaaaacaggtgatattttagtgtccaggagtagaaacaatttcaatttctgcagcacttcaataaaaatatttagatagcagatgtgctttttagtaccttgagagtatgaaaaaataacaataaacatgacgtatataccaacataagttgacagtaaattatgaatcattttttaaaacttattattccacattagccatttaactttaaaataatataaacacacaaaaaatctaccaacatgatatgctatccaacacatttttaaagtctgtatttgaaaacctttttgtagcactgacagacatgatcaatatcaatgttgtatataatcatatttgtatatgattgtattataaaattgtatgctatttactttattgtctgaatttcaatataagaaatctataaacatcatgcatatttattagcatattttaatacgattttaaaagacacgctctaatatacatacatgagtattcatttataatatattttatacaccagcattattctcagttttaattgaaaatatacatttttgaatataatactgatagtgttgctaattttttcatttaaaaactgtatgatctttttaacctgtataatcttttcaggaactcaaataataggtctaatataatttgttttaaatgtaagatttaattgaaaatttaaagaaacaattctactaaatagaaaatatgatataatgaagcacaaaatgttgagtcttgggagtgcgaggcgggcggatggcctgagggcaggagttcaaatacaaaatttagctgggagagatggcaggcacctgtaatcccagctactggggaggctgagacaggagaatcacttgaactggggaggcagaggttgcagtgagctgagatcgtgccattgcactccagcctgtgcgacaagagcaagacttcgtctcaaaaaaaaaaagttgagtcatatttatgtctccaggaaatatagtcaaatacacacacagacacacatagacacagacacacatacacacacacacacacacacacagaggcaactaatgaatatgcacatcttcaattgtccctattggtaactatataaaaatatttaatataattaattttacttaatttatcttatattgtgaaaccataatacacaaagaaactggtcactgctgtgatattgaagtaaggttttatcatagcatcaatataggaagaggtgaagaccaataaagtccatagttaacaatgtatcggaccagtatattgaattttacattctcttcaatatgtgctcctaacaaattaagaaaaaagttataagtaaaattagaaaaccacttagccccaacaaattattgcagtaattttatcataatttttatttgatgaatgtaatctatacttattatagaaaatatagaaaacacctcaaaatatatagagaaaatatcactatctcaaaatataatctatcttctatcttttatattattatcagttctttgttttaatattttaacctaatctcatttcatttaactttacttttgaatattttggcatgctaatgaatctcatttataacaagattttcaagaaatatttataaacccataaatgtaattatttcattttatcccataattatttttgaatgtctttgttttaaatatttaaattcaatctaaaatcttactgatatatataatactaaatatatgcatagtttaaagctttctgaatatctctaatcattcctttgtagcaataagtgtaattttatcagttcaaatagcttccaatattttgtatcacttttgttacgttctgcccaacatccttctagaaatactatgacaaccaacaaaatctccagcactctatcaatatgaccttttcatcaaatattctgcaagtatatatcatgttatatttttgatcaatttaatttttttgtttctaaaaataaggaagtagaactagataaataaattaatggcttattatgggatatgcaatttaaaaccaataaaattcctgaagtaggaatggagaaagaggcaatctctagcactattccatccaagtggttttgcatccaccacacaggaataatagagaatctataatatggactgaaaggaagatgctacttctcctatagaagaaagataatttgtataatctcattagtaactggaagttgaaataaatttccctgcctagcagtaggtctgaaaagaggatttgttgactgcacaactagacaaagtatataaccaaatttaatcttcaatacatctgctggttttcacatgataactgatgttgccgtttataattcaaaaataaaatgggaaaatgggacctcacatgccataaatgaaacagcacataatttttgagactcaagtaaatcatattattgaaaataacttactgcagaaatcagaagaaagtttagaaaaggttcacatttccaataatagaagatctccgtaaaactggagcttgtggccaggcagtgtggctcatgtctgtaatcccagcactttggaaggccgaggtgggtggatcagctgaggttaggagtttgaggccagcctggccaacatggtgaaaccccatctctactaaaaatacgaaaattagctgggcgttgtggcgaatgactgtaatcccagctgcttggaaggttgaggcaggagaattgtttgaactcaggaggcagaggttgcagtgagccaagatcacaccaatgccctccagcctggatgacaagagcaaaactccatctcaaaacaaacaaagaaacaaaaacaaaaaacaaacaaacaaaaaaactggagcttgtgattttaagatatgcaactgaaatggagatcattacaagccgacgaaataaattgtcacatgctgtcagttttcagtattcgggtatctaaaacaaaagaggtttaaattatgcttggagaatacagcagtccaaaagtaggaaatcatgtttgtataatagaagatactatggtattctcagaatatggataattaataaacacagagataaaacaataaatgattgcaattattaagattgaggaagggagtagaaagtaaacatggagataattggtttctgtgaaatagaccctcaaatagatgaaacagatgggcgttgacacagacaatgagaaataaaatgtcataacattcatctgaactaaataacaattcttgtatagtgcttgagtttaccaaatttttttggcgtgcaatttcatcggctcaaatagcctctaacattctgtatcgcttttgttcaaacattctgccaaacatctttccagaaatactgtgacaaccaaaaaattatccagcactatcaacatgcccttttcatcaaatattctaagtatttatttattctaacattttcatctaatattctaagtaatattgaaatattttaagtaaataaaactagaaatcctcacaaaaaatagtttaagcgatgcatggtggctcacacctgtaaactcagcaattttggaggctgaggtgagcagactgcttgagcccaggagttcgagaccagcctgggcaatatggtgaaaccctgtctatacaaaaaatacaaaaattagtgaaatatggtgctgcatgcctgcaattctaactactcaggaggctgaggtagtaggctcacttgagcttgggaggtggaggttgtagtgagccgagattgtgctgctgcattccagcctcaatgactgagtgacacattgtctctaaaagaataaataaacaaaaataaagttttaaaaattattaaaaattatgttgttatttaatatgtttactgaaatactaaatactacaatactaaagctttacatggataagactgttcaaatataagttttgaattataaaattttatacccagcaaaattaactttttttgtgaagacaaatggaagatatgagatctaaagtatttcaagtattcctactattgaatgaaggcttcctaagcattttgaaatctttatcaaagaaattcttggaaatattaaaaccaattgatgattatgcttaaattatatgtaaaatttaatgtatgagaattattagaaaatataatataatacaacataatacattttaaaatttcttaataatttattgacaaagactgagaattgagtagagaaagtggatagagaaaagaaaaatattttcatattcccttgtctcaagtggttggttttagggtgatatggattaaaaatacagcattctactgaattataaaaattaataaccccataaaaatggaagaaatggaaaatagatatgataataatattagtaataatataaagatgacaaaagcaaaactacatgtcctatagcaataatcatgaatgggctatacatcctaaatttaaaagagttacaagcaattttaaatactatagggttgtaataaaacattaaaagtccaaggcaggcagatcacctgaggttgggagttcgagaccagcctaaccaacatggagaaaccccgtctctactaaaaacacaaaattagccgggcgtggtggcagatgcctgtaatcccagctactcgggaggctgaggcaggagaatcacttgaacctgggtggcggaggttgcagtgagccaagattgtgccattgcactccagcctgggcaacaagagtgaaactccatcccccccaaacaaacaaacaaacaaaaacaaacaagaaacattaaaaagcatcatatagaattataaaagaataactaagtatacatcattaatacataaaggaagtaggtttatcatattaatataaaagtgtgaggtgctatgatacaaaataatagtaaatatttaaagctttttttagtaataatgtattgcaaaacacaagtgtcatgaaatcactttgcagttatgcatgcttttttgaagaacctaaataacaacttcacagattgaccagcatcaaagcatataaccagtatgtcatcttggagtttgatttgttgcctcaatgacatcagaaataactttgtagttttgataagtttttctttctatttctgacatttattgcatcaacaaagcacccaaatttaagacccagaacactaagtgagttttgttgttgttgttattttttttttcctctctgtaaaattcagctactcctgggacatgatataaatactctcattggaaggtacacgtcccaatttttgcaggtattgaaagtatcagttgaccaatgagaactcaggcaagccaaaaggcaaaaaaaaaacccaatttttaaaaaaattttgaaatttcttttaaatatctttttttattagagacacagtctcactctgtcacccaggccacagtgcagtggtgtgatcataactcactacagcctcaaactcctgagctcacgcaattctcccaactcagcctctgtagttgatggaactatgggtgggcaccaccacacctggctaatttattaacatttttgtagagacagggcctcaattttttgccccggctggtctcaaattcctggcttcaagtgatcctcccacctcgacctccgaaagtgctggaattacaggtgtgagccactgtgcctgggcagaaagattcttgatttacattgaaggggcctgattaaaatattatcaatattccaactattcaattagaatggctgtgcctcttttttttttttttttttttttgagacggagtctcgctctgtcgcccaggctggactgcagactgcagtggcgcaatctcggctcactgcaagctctgcttcccgggttcacgccattctcctgcctcagcctcccgagtagctgggactacaggcgcccgccaccgtgcctggctaatatggctgtgcctcttgcttcaccttaattacagatatctatctgattagactatgataaccacatgcctgtgtatacagtgcttgtacgtgtgtgattttgaacacgaatatattgaacaacagaattcaattctaacagcaccttttttcttaatcttttttgttatatactttctttacctgacacaggcaaaaatctattttaaagtgaaaaattaggtaagtttataatgatgaagtatacagtgaataatgaaggtataactgtcacaaatctctgtattctaagtaacagttttggaaaatatatgatatccaacatgtgaacaaattatagaaaacataataagctaaataggaacaattattttctgactacatccaaataaataggcaaagtaaacacacagaggcatgccactgaacctgattgaatttatggttatttatttatgggtaattaaagttaattttagagttgtagatttagctagggttgggaacaaatcccagttctatgacctgctcatggcgagacattgatcgcgtgactttgtctttctgagcctcagttttcttatttataaaatggagatcatatttatcttcaagaattgctctgagcatgaattgcatatataaaaatcatgacactttataaagtgacataatattatagtatgtgcaatagaccgaatgtctgcattccctcaaaatttgtatgttcaaatcctaatactctaggtgttggttttgggttgtagagcctttggaaggtgattaggttatgagggtggagtgctcatgaatgaaattcatccccttataatagagattcaagagagatctcctgacctttctgtcatgtgaggctgcaatgagaagatggccatctatgaggaagtgattgctcaccaaacaccaaatctgctgacaccttgatcttggacttcccagtcaccagactatgagaaatagatttttgtaatttataagctacccaatttatggtgtagcagtctgaatggactaagacagtgtgatatctatgtgtgcctattttaaagtgtgcttagataccttggtaaatagtaaaatacaaatttattaaaaattatgaataaaaacatgtaatttttatttagtatatgcaaaataattcaaacaaattgaacacattcaaaaatttattgttcagtgcctagtaaacatgtattaggcatcaaatttgaactactcttacatttcacatggctgaaaagccacgaatcatctttgcatcaccatttagccgagttcatccacagggagggctggctgagagtttcatgttcctctttgattggtgaaaggtgaaacccttttgttcacccagtaaaccctgttggaggcagataagggaaaataaaatttcagctgtcatttccaggctcccatagaagacaaagttgactctgcaagttgttttcaattcagtgataaggctataagtctttgagtctgcgtgtgtgtgtgtgtgtgtgtgtgtaaagaacatagtgatgggttataaattgccacacactgaagggttttcccgcagctttagaaagtctttatgagtaccattttgcaggaaaatgaggtttccctctcacatacatagtgcaggctagaagttattaattttatggatatattcaaaggaactggggagggctttttcttgaaataccagcttaccttggaatagtagttcccccggacccccagaatatcatatcattgacatctttatgaggatgagtcaagaacttcacagtcctgaggaaatgaaggtatgagccatgactgccatctccagcatcaacaggatgtcttacaaaaatgctgggataaattggcatatgctgcttgacacagggctctatttgtagcttgggttgtatatcgagcacttgtaagattgtagaaattattgtgattgttcctttatgactgcggttttgactacatattcatgtataatccagttgtcaaagaatattttttaaagcagctttattgaaatgtagttcacaggacacataatttacacatttaagatacagaatttaatggtttttagtatattcacagatacagacatttcccaactttcaatgaacttacaacttttcaacttcactatggtgtgaaagcgatatgtattcagtggaaaccatactttacatagccatacaaccgttctttgttttattctcactacagcactcaataaattatatgaaatattcaacacttcattataaaataggatttgtgttagataactttgcccaactttaggctaatgtaagttttctgagcacatttaaagtaggagaggctaagttataatattctggtagtttaggcatactaaatgcatttttgacatgcagtattttaaacatatgatgagtttattaaagcataacctcattgcaagttgaagagtatgtatatttgcaagcaattttagaacatttttatcactacaaaaagaaacttggtacacattagctatcaccactctgtgatccttctcttcccttcaaccctaggcaaccactcacctactttttgtttctatgggcttccttgttttggacattttatattaatggaattatctgtgtagtcacatgtgactgacttctttcacttagcatgatgttttcagggttcaccctgttacagtatacatccaacacttcattcccattacatggttcaggctggtctgcaactcttggcctcaagtgattcttggaccttatcctccctcatttcattttataattggataatgttactttatatgtatataccacattttgtttattcattcatcagttgatgggcatttgaattgtttacaccttttaactattatgaataatgttgctgcaaatgattttgtgcaagtttctttgtaagtgtagttttcatttctccaagtgtatatacctaggagtgggattgctgggccatatggaaaatctttatgtaatcacataaggaaccgtcagattagttttcaaagaggctataccattttacgtttccaccagcactatatgagggttctgatttctccacttccttcacagcatttattatctgattttttaattctagctttcgtagtgggtataaggtggtatttcattatagttttgacttaatttacctgataacgaattaaatttagtatcttttcatttgcctgttggatatttgtaatcttactgaaagaaatgttagttaacatcatctacccatttaaaaaaattgagttatttgtatctatgttattgagttgtaagttgtctttatatattctggaaacaagccttttatcagatatgtaacttgtagatattttatcccattacataggttgtcttttcactttcttgatggtgtcctttgaaacataaaagtttttaatattgatgaagtctagtttatctctttgttgttgttgttgctaatgcttgttgtgttgtatctaataatcacttaccaagtataaggtcaaaaaattgacccttatagtttcttctaagcattgtgtagttttcactcctacatttaaatttattttgagttaattttttatatagtgtgagataagggtttacctttattcttttgcatgtgatgatccagatgtcccaggacagtttgttaaaattatcattctttcaccattacacagttttggtaaagttctagaaaatcaataactgtagatctatgggtttatttttggactcttaattttatctcatggcttatacatttatcattttgctaatatcacactatcttgattattgttgctttgtagtgagtttcaaaattgggaaatatgagtccgcctactttacttttctttttcaagatgtttttggctattctgggttccatttaatatttaattttatataaattttagattaatcttaccaactctacaagtagtctgaaaatctgatatggactgcatagaatctgtagggaaatttggtaactatttccatcttaacaatgttaaatcttatagaacatgaagatgtaatttttaaaaattctttatttaatttatttcaacattgttttgtagttttcagagtacattttacagtaattttattaaatttattcaagtattttattatttttggtgcaactgtaaatgaaattgttttttaatttcatttttaaattgcttttgaaagtatatataaatgcaattaattttacatatttatcgtgtgtcctgcaaacttgctgaatttgtttattagttccaataattttactcagttctttagatttttctatatgtaggatcatgtcatctgggaatagagatagtctttctagtttctttccaatatcaatgcttttagtttatttttctggcttaattgctctcagtagtacttctagttcaacactgaatagaaatggtgagaacagatatccctcttttaatccttatcttagggaaaaagcatacagttcctcaccattatttgtaaattagctgtgtgtttttcataaatgccctttatcaactagagaaagattccttctattcctggtttttggagtgttttttatcaaaacattaaattttgataaaaattgttgttgaattttttcaaattttttgcagctattgaaataatcatttgttttttattttattgttatgatatatgacattaacatattttcagattttaatcaaccttgcatttctgagataaatctcacttggtcatagaagaagttatttttatctttatttttcttattttttattttttattttattttttttttttgagacggagtctcgctctgtcgcccaggctggagtgcagtagcgcgatctcggctcactgcaagctccgcctcccaggttcacgccattctcctgcctcagcctcccgagtagctgggactacaggcgcccgctaccacgcccggctaattttttgtatttttagtagagacggggtttcaccgtgttagccaggatggtctcgatctcctgacctcgtgatccgcccgcctcggcctcccagagtgctgggattacaggcgtgagccaccgcgcccggcctatttttcttatttttttgaggtggaatctcactttgtcatccaaactggagtgcagtggcgagatcttggctcactgcaacctctgcctcctgggttcaagcaattctcctgcctcagtctccctagtagctgggattgcaggcatgtgccaccacatccagctaatttttgtatttttagaagagatggggtctcaccatgttggccagactagtctcgaactcctgacctgaagtgatctgcccgcctcagtctgccaaatgttgggattacagacatgagccaccacacctgaccagaataaattatttttgtattgctggatttgtctggctgatacttcattgaggacttttgcatccatgttcacaatagatattgatctattatttcttgtgattttaacagtaggttcccatttaaatgtctaagtgaaaaacaaaaaatgttttctcatttagttctactcttaaaattgtcacttattgcttctttaaaaagtagtttaataaatggtaaaaaaaaaaaaaaaaaaaaaacagggtaaatactgaaagtgttaatttgctttatggagaaaggatattgtatatgtaagaggtgtgggcattactactagttttgtttattaatacatgttttaactttcattaatcccccagtttctctcccatattttaaattcatacaattatattctgaaataattcagataaagataattcacattagattttgccccagaatgaaatcacttcttcaacttccttgacatttgcatagcattccaacataaaaaataaatattaacaaataaatattaaaacttctctattattttatatggaattccatagaaaatattaagcaacatataggtattattaaaaataaattagaaacaaaatttctgaagtattgttagaaaaaattgttgaatcagatattggctttgcttaatttttaaattcattggtatacttctattattctcatactttcataatttctattcagtccaaggaatggcagaaaacaactgaaataataatgaggaaaacatctcaactgtatgacaatgaatagatgttgtgcaagacattttataattcaggtaaagtagtgctcataaagaaacttaaagcattaagtgcacatattagaaaaagaaacaatggctgataccaaatgacctaaacatctggggaaaagtacaaaataaacctaaagaaatagaagagagcaaataataatgatgaaataaaacttaggtacatagaaagaaatataccatcaaaatatcaccaaaggtaatgctgtgtcatttaaaagattacatttataaaagaagcaggattcatacagcaggattaaccaagaaagaaatgaaagagagaaaacacaagcttccaatatcgaggttaaaaaaagggaatattactttaagttccgcagacatttcaaaaatataaaagcaactttaggaaaataagcttaagattaaatggtgtgagttgtttaaaaaacacaatttaaaaaactatctttatgtattggtaggcacgataatccaaataaagaagatgtagacatgtagacaaattatgcattatgctgagtatctaagtttgttagcacagaggacaccacgttgctttataatgaacattctgccatgttacgtattatttcttagaaggacctggcatagttgctgatgcaaacaacactacatcatgttctacacaaaggttggtgaagcagttcccacaatccacacccgtcctcctccaacatttggcataaacccaatcaggagagtctttgctccaaaaaacacaatcttcaactggaaaataatagaaagtataaagaatgtgttctattttaaaaaaatatttatttattttaaacttatttattttatttattttaaatttatttattattaataaaataaatcaatatatattcttatattaaataaagaatttctattcccagattgcttattcagttaattatttaatatttagggaagacgttataccaatcttataaaaactttcccagagaatagaaaaagaggaaacactgaaaatcttataataagcaaatgtaatttagctcttaaaatctgacgggaatatgttcaggctagagtatcttgtgaaaaagatgcaaaaatactaaataatagcaatccacatccagtgatgtattacaataacatgacctaggtataaaaggagggtttgctatcattgatttaattcattacattacattaaaaaaggagaaaaaatatagtatgaatctttcaatagagtcaggaaaagcaaacaatgcaattgagtacttaccttgaaaaattccttagcaaacaataatgtaagaaaactgaaaaaaaaaccgaagaaagattactgtggctgagatattccctagttatcacatagccatgtgcttggtctcacgtattccccagcctcctgtggtttggttgagtgagcgattcgatgacttctggccagaagcctgtgagcaaagcatttatcagctggaacatgatccttcagttgtctttctttcacagaagcaaacacagaagttttgcagtaagatgcaaaaaccacaagatgggaaaggaccacagtgaactttggtattcagcctgttagattttcataaatgtttattactgtagaatagaataacataaaattacttgcgtttcttcagtcattctaattttaataagtgttaaattttgtttgcttaagttaaaatgttacatatttgtacaaaacttgaatcattagttagcatacatgaagtaaaatgacataattattaaaaatatatgctaaaaaaaaggaagcaacaaccaggcattcgcctctaaatgacatttctctgcatcagctatagaatcatttgtcacaaagtgatctttgaggatccatggagagagcacagaacagcctgtgagtcctgaccccttgctatgtacgacgcaattaaaacattgctagcatgatacaattgacacttgctttccagtcataatattcaggaaaacttctccatctatagtaaattctcaaaaccaatacagaaaatatttagaaaatatataatgcaatttaatgtaaaattttgtaaaaaagcaaaaaaattaccctgttgctaaaaatagaaaagccagagtgatgagaaatgtaagaaaaaaagatgaagtgaataatgaataaattaacagcagaagggaataaactaagaagtaggtaaaataaaagaaaaagcaaccctcaaacatgttctaatatgttgttgttattaagaaaacaaggttcaaaaattccatatttattgatgtaagagatagttttgaaaaatgtaaacttctgaatgcaaatgatttgtgattagatgaagaaacattacacacatacacttttaaaaagaaaaaaactattaatatcagtaacaagaaagattaacaaatgcttgtgatttgtcatgtatcatggttaatttttctatgtcattaattcataaaatagacccggtaacccaattagatgtatactgttacggcatttattgacaaataaatagtttccgggactcgctaagaattattaaactcacatatagtaaatgagaactccggggttgaattttagtcttgtctgactccaagaccttcactcttaaatgccacactaaaatgcctccaattataaagcaacatactcatcaatatgactttttaaaggaagatttcagactttaggaagcagatacggagagatataaatctattgtctgaatcttttgcaataatgagtccttatgctctaattgtaaatgatcctgatgagaaaataagttattcaaaagggagatgtacagtacatacccttgaccaactcagcattttaggtcccttgagaagagcaagaaaggcaaaaatatcagagcacaataaaagataaacagaacatagcatgcctatattaataatactgtgaaagaaggacagagacccaaagaaagtcagagattttaaatatgtcaaaaataattttttaaatatccatgaaaactctgcttgggatataacttacactatgcagagaaatgagcaaccaacacttactttgctttccatctttaataaaactgatttgtgaagaagaaagattggaacaaacatgcgtaggatacagatgaagactaaaataaacaaagagatcaggagaaaacagccagatactctaaatgagtttaaattccctcattaaatgagtatcacaggataatcagtgacttgtaaatgccattaatgagctctaccaggtaatgttgatgaatactgtagaacagacctagctccagaatattatacataagcaaatatagcttgtctttctagaaaaatagaagttaaagtaaaatatagatttggatgcttgccacatatgctgggtaagaatctaagatgtcatgatttcaaatatattataaaatgtatatgtttataggccatcattgaagttttttttatatgttaactagctaacttaactgcacaggaaggtattcagttaacttgaataattccctcttaatttatttttctcttgtcatgttacccactaactgtcacacctaagtttttaggaaccaattatcctttataaacacattaccatacacaatcaatctctttcagaacctataatccaaacacttgatttggtgaaacctagctcttcccaagaattttgctacctctgcaaccttcttaaatgaaaccttcacacattctatcatgtcccatataccaccaacagttgcttttccctaaatctccattgccaggatcaaaagattagtcatcagtttacatagtctattaactaaaaactcaccacacacttgtgaatctgatacctttttcactccatcccaatttcagctttgaaaccgagggatttcaacattcacatcactgccccttagccttatgatttcctgacctgataaattctagtagctttggtatcactttcatttcagccatgtacaccactggccacaccacacacactgtcaaaatccagcactgaaaatatctaatacacatacaccaaatataatacaccattttctcactataacatcctgtccttctacgtatcttatgtccttactgacatgatttattcttcctaatctcatgctaatttactcataatttactcataaattagcataagattaggaaaatatggatcttatattttcttttttattcactatgttctgaggtgcatcattttaatgacgctcttgcatggatggagttaaaatgagaatttaatgtatttggtaatatgcctatatattgagggtgcctgattaatgcctggccagtattttccttcttgaagggttctacaagtggaaaataaataatatattttaataattatatgaatgctaagttcaccaatgagatagtggtaataaagccgtgaagagaaatccatttaatacttaagacataaatgacacttccttctttccccacatagaaatgctagcatcttaccactttctactctattcaagaatctaatacagtaaccaggaattttcaagcatgattaagcaaagacggggagagaaataggatttaacttgttttaagaagtcagatactaggccaggcacagtggctcatgcctatagtcccaggactgggaggctgagaagtgtatatcacctgaggtcaggagtttgagaccagcctggctaacatggtgagaccccatctctaagaaaaatacaaaaaattagctaggcgtggtggtgcatgcctgtaatcccagctactcctgagcctgaggcaggagaatcgcttgaactcgggaggtagatgttgcagtcagcctagatcacaccactgcactcctgcctgggtgacagtgcaagactccatctgaaaaaacaaaacaaaaaaccaacaggaaaaaaagaaaactaacaaacgaaaacaagtcagatactaggtcaattttctcaaaaacttaatagaaaaggaaagaaaaaaaaagagtataccatgggcttatgtcttttaaaaccacaatctcccctacaagcaaatcagtgtgtttgattatggcaaatcagattagctatttctcttgtcttgggtattggatgagacagccaggaaatgggtggccagaaagacaagtaagggaagctttctggaaattaatcttttctttccttattccgtatattgaaaacactctcaattatttttttacattattttttcaacctatcttgtatacaaacacagatagctacatggatagctataaccaagaacctttccaagccctcaccaagctactgggatacttggaattaacttggacttgacagatgtcaataaacccagtgccttttctaaaatgctggaggctagtgtttttagtattgacaatagaatcagtttttagaaacataatatgttatatattaccctatagtagcctgtttatccatgataatgaagaacccgaagaacatagaaattttcaacaacgtttatttctcacttacatgaaaacggtagctcagctatgagtcagcggggacggtgggggtcgggggggtaaccctgcagctcttttcattgcaggagaaaacagcccctgtctagtccctaagcaagataaccgttctgttgccaaaaatggaatacaagagaaaaaaaaaaaagacccatctgatcttgtatttggatttaagacttattttcagagatggaatgtattttacctgctcacatctcattagacagacaaatcacatgaccaggccctgcctcaatgggtcagggaagtatactgcttcgagagagtagaatatttgtaagtgattttacaagatactacattagtatataatgaaatctttcctttagggaagggcagcgctttgtaaacaaacactgtagtccctccttgtccctggggaataccttccaagatcattaatggatgtttgagaccatggatggtatccaactctatatatgttttgttctatgcatatatcatacgggtaacgcttaatttataaattaggcatagcgctcttggactttcaggacattattaagtaaagtgagggttatttgaacacaaacactgtcatatcatgataatggatttgaaccaagattgcaattagccaggtgtggtgggaatcacctgtagtcccagctacttggaaggctgaggcaggaggatcgcttgaggccagacatttaaggctgcagtgagctataatggttccactgcactccagcctgggcaatagagcaagaccttgtttctaaaaaaagtaaaaaataaaaagacttctactaagtgactaaggggatgatagcatccactatagtgtccagggaggattcacctcctgggctgaatagatggagaatgtgcaagatttcaccatactacacagaatggcatacagtttgaaacttatgaattgtctatttctagaatttttcatttaacatttttggaccatggtggactgaggtaactgaaacaatggaaaatgaaactgggatgggggaactacaggactttaatatcactggagtacaatattaatgttcgacttaagaagcataaagaaagatgactgatagccttaggacaaataagcccaggtcttgcttccaaaagtgtttgtgtcaaatatttgaattgaaagtgatgattaaatttttggtatactatgaattttagatttcagaatttcaactgaggaattgtgaaacattttaacatgcttatgacacacaaacttatacgggcatatgtctatattttaatattcagactttgtatagccttatattcaaggtgtctttttttggaagcgacttatgtttcctgtttaatgctcagtctgcttgtcattgtcttgtaattgaaaattttactccatgataggtaatataattaatgataacctttagttcaatctactgtcttactatctcctccctgtatgacccacttgttatagtgtctttctctttgttcttgttttccaacagatgtgccttattaggggttggagtattatcctgcttgttatttgtagcacattttgacttcatgcattaagtctttcaccagtgttgaaaattctcagccattattaactcttgaaatatggcttcttctccattttttcttttctcttctggaatcacagaccctattatcatgccagatatgttttgtatgtatgcgcctgcaacccttttttttttttttaattcttccttctatgtttctgtatttctatctgggcaacttattctgacatgtcttccatatcactaattcttttttaccagtaacgtatatcaaaatcctatatcttgatggaattctttctccaagtaaattgagttactcaatttttgcctaatatttatttttgattagttataacatctatgactgctgcattggatccaataattcattttcaccccaattcattgattcctaccttcccctggggcctagttctttcattaaaggagatttctgcctctagttctaccacctactcactacttgcatacgaatttgggatatcacctatcatgtcatcctcaagtggtggcagagggccgctaactccaccactacctcctcaacaaaaatcccacattctggtgaatgaacacttgtggacacttgtgccaggcctctgatggagtgagaccaccaatgcaggccctgtgcagcacagcaatatccagaagttgagttctgagggcagcatattgcctaagtcaaaatgtaacttcagcgatttatttcataaagctttggggcagaataaactaatgcatataaaagcaggagaaaagtgtctagatgacaggaaattctcaataaatgctacttgttagaactactccttaacaatgctacttactggacaagatattttgcaagatcacatatgagttcaatgctcaaaactgaaagtaaacttaagaaatattgagtgctgtgctattgtgctatgtgagtattatatatatcaaaaaccatgtataataaatgagaatattttggaaccaggtagacttgagttagcactaattaactacatgaacttgcatgaattaacttttgtaattgctttctttttgaaacatggtatactactgccatcttagtaaatacaatcttaatgagattacattaagtattacatataaacatataatacagggctggtttatactaggtactcaataaatggatttccttgtctagggtgatactagttcttcaactttcttcttgcaaacagtaaattgccaaaatatttaagaattccaacatccctgttaatataaatatatgtgaaagatgatagatggagagataaacagagtgattctaaatctgatggagtagggatctttaaagaccacaaccattgacgtcaaattcatgtttggtcttttgcctgccatagctactccatcttctctcaaatgtgtccttgatgatcactgacctaaaaagcacactcattttagtgttttgtttgcttaagagctgatttaaatattacttggttttattattaaaatctaaaaacctttagtagagatattttaattggcagatttttcagcattattttcaaagctcattgtgttgtatatcagtctctaaaataaatctgttttaacatatgggctcctcaagtctcttattcggagcagctgaaaacactcatgttaagggacacctgtgtctgttcttatgcaggtagttagagaaatagataatagtgaaacatatgttaaatcatatgacatatggtagtaacactgaattagcctgcctaaaactgtgatctctgatcttctatgacttttttttgtgaagccttacagctagtttacgtagaggttcctcttttttgtattcacttttctcatattttctataatgatataaaaagaatgtgttttttggggtagaaattttactgcattgtggcacttttaagttttttaaggttatgatacttaaaattattataaaaactatgtgtatatatatatatacacatatacttaagaaaaataaggaaacttctttttaatcacattcaatattcatagacataattcttcactttaattatatatctaaacaaaataccaaatatagctgtcaccactggctttgatcaaaataactagttagatgacaggacagctactggaattatcattagggaaaataaatattcaatttacctttaattttgttttgagtttgccttcaaatcagcacgttttctaatttctccaatgtaaattgcattataaaacctggttttactttattatttttatggaattaatattaccctatctttattatcatatatatttaaaaggtatatcagattaatcagaaatgttgaaaaggtcagatgatttaagaggggtgtgtgcgtgtgtgtgtgtgtgtgtgtgtagtatagatatgtagatgaagtataaagactaaaattcaaagcaagagacttaatgaggaaaattatttaataactcaattgtgccagagcacagcagttattttataaattattcatcattattaaagtagttgataattaaaaatgtggtcaagacatatctccctacccagactggggaaaatcaccataaaaatcagtgaaaagatatatgctttattgaaaaatcccttacattggaaagataaatacaaaataaatgtagctagcaattgtgttctggttacttccctacttcacacacacacacacacacacacacacacacacataagtatcatatataaatatcagaagtacaaaaacatatatttaaaaaccaagattcatttaaaaatttattttatgatggaacattatacattaatactggtatttttagaaaataatgctattaacactaaaaaattctgtgaatggaggaggtagaggcaggatgagtatttcgtagcatttttgatgtgataatgcacgttttataatgttctgacgtgtttatcaactatttgagccatcgtaagggagaaggttgttctattaactcccagaagtgatcagagtctgttttggttaatattccagggtcagtttcccacattcagttgaaggactacactgcactatgtctgtttaccccccatgctagctagatgattttatttggatgagaagctgaaatacctagtatatatacttgctacaaaaaaatctgggcctatgttttttacaaaaatatagttattatttagacatattggaagttgcatatttatatagcagagtagaatttgaatcagtcaaggtaagattttaaagtgagtggatttttatattatggattgttgcactgcaaaacattgcatgactgatccattgacatattctgatgtaataggtgaaaataacatgttcatcaaattaccatggtaacacttcaaagacagagagagctgctccttcttatcaataggaatatactcagaatgaagtgagtttacaaagctcagcttctggaaactatcttccttctttgccatggggcaaaaggacattttctacccacatgcttctgaagtcatggaattctgtcagttattcactatgtgtagaaaagataacacctatatgtttcagaattgtagaaaataaatagtttccttaaagcaaacattgtaaatattatggactaagatttttttcatatggacctagaaaatatacctgtgaagatatcttagaattctgaaagatacaagaacctaactgttcctttttaaggaaaaatattcaaggtcttaattgagcttctttatttgatagtcaagaaaaacaaaataaaatgacctaaaattgactaacattatgagattataatactctaaattttaactgagagtgaaaagaaaacaaacaaacaatagaataagctatgtggaaggaaatgttccctcatcataaattaaattttttccaggacttaaggtatctctcatctacaaataattcacttatgggtacagcactcattgatcagccatcacagagctatcttccagcctgaagatacactaacataagattttaaaatgttagcaggtattctgactttagtgaagtgtattttcttaagaaagagaaaaaaggaaggttttatttggtaggtattataaatcattatataaacttagaattgtgcaggcttcttcttgtacattagcaaagttaaagcatcattatgctttctttatatgtgcctactgtattcttcctgtttttaagcgaaggtattagttaatttttaatttattgaaccattttcttatatgagccagtatgatcctcagtggggggctaaatcaaagagcttattgcttaggagattatcatgaacagtcaagacagttttagcctcaagtacatttttgcaggtcattgcttcctatctaaggcaatctctctgaagttcaattctggacagcaaaaatatagagagatgaaagtatctctcatccatttataatcaggccttaattgatctcagcagatttcctaattgcagaagttacctcaggtaggtcacgtatttcctcatctgtggaatcttgctgccataatcagcactttaggtgttacatggaggcttcagaaatccccttttctagatataataaagggaagaattattatagcttgtccctaaaataatgtctttggcttcaggtgcaaagccacaaaggaaaatactatgaattttaagaaatgaatgaaataattttgtgaacagaatgaaaacaatattttaacaattaaatagtatttacatttctgtacacacttaaaacttgtttatgatttttttggagtgagtgctttatattattcatatatttatgtatgaatatatatatttatattatattatatatttatatatgaatatgtatagtatatttatattatattattcagtagaatagatttaccatgaatctaaatatgttttaggtgctttaactagaccagtaagagatcggatgaaatcaatgcaaaaaatattattgtgatgaaagtttctctttgtatgttatttatatttttctctatcaaatagttattttttctctgactgttattgtaggttcaagggatgcatgtgcagatttgttacaagggtaaattgcatgttgcagcagtttggtgtacagatttttttgtcacccaggtagtaagcataatatcagaaaggtagtttttcaatccttaccctcctcccatcatccaccctcaggtaggatgtgatgtctattgttctcttctttgtccttgtgtactaaatgtttagttcccatgtataagtgaggacatgaggtgtttggttttctgttccgacattaattggcttaggataataacctccagctagatgcatgttgctgcaaaggatatgattttgttcattattatggctgcatagtattccatggtgtatacgtgccatattttctttatctagtccaccattgatgagcatctgggttgattccatgtctttgctaccgtgaacaatgctgtgatgaacatacctgtgcgtgtgtcttcagggtagaacaatttatattctatcgggtagatagctagtaatggaattgctggggcaagtggtagttctatttcaagatacttgagacatctccagattgccttccacagtgactgaactaatttacattcccagaagcagtgtataagggttcccctttttcctcaacctcaccgtcaaggagttagcttatgatagttacattacatcaaaaataaaatgaaatctgattcattcatcctagttagactatttaataattattatgattgctattgaactgtagctaatttttttcagcatttatcaaatacctgaaaagaatctcacccttccacatttttttctaatgtagttgtatacttttaattgtttctaagttaaagaactattatgtatttgaaggttttgacattttatctatttgcttgcaaattatatttatattctaattgctttagaagaacatatctagtccaaaataaaattggactttatttctccatatttcagtaattttcatgattgttaaatgcaagcatttcagattaagttttatagaatctgtagaagccctaataactgggtgaaaattttgttatgaaaatatataagcatattctatttcaggtacaccactggtcatatactgacttatcctgaaacttatgtttaattatagaaaataattagctactgcagttatataatgatttctctggatgatgagtaagcattacagtccagcttatcaacatgtaggcctacacttttcatcttgtaattcaatatgtaaaatgtcaataactaatatcattcatccattcaaaaaactgaaagtgatcatgtccttaatgcaaaatctcatctcgtttctcggtcctggtccaagccaagaatctctaaatgaatttcctaagttgatgtctaactcagcggaagctccttaagactcagaaatccatagctaaatcacaacccaagcacatttggattcaggataaatatggtaataaagtacatttgaaaaagttaagtaagtagaaacaggctagaatggtcattttttagcaaacatcagtgacatcttttgtgaaaggaagaatgagcaaagactctgagttctgcaggtggagtgatttattttgagaccacctaagtagcatttcttaattcttctttcttggaggccttttctgtgtccattgttctctatggtttgtccagacagacattagtgagccttcttctgctggagaatatactgctatagaagataacttcattttagtattagtgtggacgcctgaagattttcatttgtgactgagaaaataaaagtctctgttttctaagcttaaggtttattcaacaataaaactctctttaaaaagttttagtaattctttgtatgaatagttttgcaattgtatgggctactgaccaatgccagagagacgacaaccagcaagaggggtggggaagttctgtcatttaagcaacacatcagcgacccgatcatttccctagctctcagttcaatggcttccattttggagtctcactcggggtcaattcaaagcattcactggagaggtgaagacacatgtaatctttcactcatttttggaggcatgcaaataatcgttctttaatgaacacagcagaaagagttctctaatcctaaccttgtaccactttccccctaaatcctgattctttcaaatcttccagattaacacagcactctttcgctttgggttttatgcggaaatagctccttcataaagcctgtattttctttcattgaacgttcaaatggaatagttttcaaaacattctttcttacaagacattactgtagactgcaaaaaataacaaagttacttgcatatgttgagatatttctaccaagtctcctaatgagccagctatttaaatatataatctaatttcaagacgtaaaagttaagctgctagtttgctaccacacaagaagtattgtaaccttcccagttaaggatggagagattcactctgccccatactcaaactttacctcagtcaactccacatttcgggttcttgtattaggaacaaaattttaaggaacacgtccttattagtaatattttaatgtgaattaataaaattgtgaatcaaacagatttaaacaaaaagggaacgaacacgtttacttagaatgagaaggccaaggcaggggataactgtaggcaaaatggaacaaaatctaaacacattgttctctttttgtctcatagctatgatttttttttggatttggcttcatggtccaatagttccccttaaatcccaagactggctttcagattaatgcattcattattatatttagaaaaatagaacatcttaattaggcaaatcctgtacccacatccctagagacagaaggaaaataaataaacatcacccaaatcattatcgatggcaaataggggaagtgtgttgggtttggatgattaatgcacagcacccattttttccctcttttaaatgtatttcctcctgcagaggttgtaaacctaaattccatattttacaaactctcttattaagtttttggaagcaaataatatgttgccaattatatatatttgaaggaagcttgaaagaaggaagtcacacagaggtgatctccctgctgctttaaaaaacatttttctccttctgagaatccaaagcaggggcacataaattgcaagagcattgaacacagtgtttcattgtctactcattagctgtcaaaaagcaggcagtatgctcggtgctgtgcaggcttcctgataggtgtgatattactacagctagtccaaatgcttgtcacctgacttcagtatgtccaaactcttccacaaatttgtatttctatttaaatacattttattttcccaaataatttgagatttatgaaaagattgcaaggagagtttccatatgcctccccacatacacccaattatttctatcattaacatctttaatttgtatggtacaagtgttacaatatattgatcaatatcagtgccttattattaactaaagtccattcttcttttagattatcttagttctgacaggacgcagtggctcacgcctgaaatcccagctctttaggaggccgaggcaggtggatcttttttattttcagattgtttgctgttgacatatagaaatgcttctgatttttgtaagttgattgtgtatcctgcaactttacaagaataatttgactttttcctttccaatttggatgccctttatatctttctcttgtctgatcttcttccaaataaagctgttctgagctgcctagagatgggaatgggttgaaacaagcacccctgtggccaccaacactgggactgtgctgggtcaaacctgaagccaacatagcactgggtctcacccaaggcctgctgtaaccactgcctgaccaccacctgtgtttgctcaaagtcctggagctctatgatcagcaggtaatacagccagctaggcttctgctctttctttcagtttgatgagctcccccaggccctggctggatccaaaggtgcagtccaggagacaaggacttgattaaaaaaccttagaaatctttctgatgatctattgtggtctatggctgagcggggtcctctgcctggttaggtgctttgagaaggaagatcaaagacttaaagtcccattttcattgcatcgtatcaagagtacatataatcaacagacttatcactgccaacgtcggccttggtcatttggctgagatagtgcttgttaggtttctccgtggaccatactccattccttccaaactgtatgtaccctttggaagaaagtccctatgcatatctaatacataaggagtgaagagtcatgttccgcctcattaagggtgttttatatctacataaattttttgaaatgcttttacatgggagatttttctcttttctctttttaaattatttattaatttctttatatcaatatgagtttatatattttgttccatactttgggttataatcccaaaactactcattaattttgttgctcaaattgtccaactttggcctttcaaagctctttcttttggcccttgtgcccttgcacgtaccccactaatgcgtatttttggttgtattttgcaatttttacttctggtcacttccttattttctgatcttacgcatgctccaggcttatttgcacattttctgccaaattctataaccagttatttctctgtggagtcctttaggatcctcttatcagagaatgggtttagaaaccatatctgagcagtaggtgtgcttactgctactggggtgttgatgcttctagatcatatttgctaaaagataaaagatttatatgtgtgtatgtgaactcttgcatatatcgttatttataaacatttccatctgtaaccatctgtatctatattaagctaaacatgagttcaaactgacgtctccaactctattactacatggatggttctagtaaactccaaagtggtaaaagacacatgtttgtgttgaactaccgaatatgatttggactagtgctctaaccctcatgttctgatccacagaggcttggacaatttgatgagcatcctcaaaagcaataatacttgtaaaatagaaataaagaaaatacagttttttaaaaaccactctaggtctgaagaagagaaacttactgtcagtctattttacagagagctagagagttacttctgtacccagttaaactagaaaatgtactacccaggacacatcaatagcgtatacaggcaaattatggaggtccatagatgctacacatgtaaaattactacacatattcctcctggatttcagtaactggatctgaagcaatgtagaagggtaactaggtgctgaggaataataagatgagatttcagagattactggacatcatcttagagctaatattaatcagagggacccaaaacatgactgtgtttcaatggtgagaatatgacattatgggttaagcaataagttttgttctgaactaattctgtatcctggagcttgtaaaaagaatacaccctgtggatatttccccagtttttggatatatattaacatgagacatatgtggcaactgaaagaatcctatatttgttctcttaatgttggagcgggattttgtattatatcaatatccaagagtaaatgtctgtgaatgaaactcttaccaaaataccataaacaacagtggactcctgaaagaattgtggagggaaaaccataaaactattgaaaaattcaggggtggcaatttctatcatattccttcttgtttacacaactgactgtgctctagaaaaatcatttagggcctaacagatgatagagcatcaaacaatcttaataaaattatgtaaaattgtgacttcaaatgcaatagggttttcagatgctagatcaaattaatacaaatcctagattgttatatgcagcaattattttggagggaagagagagagagaaagagagagaacaataaaaatggtttaaacagctttcactttgcaaggaaagcaagacagcaggacagttttggtgccttatttctaagctatatcaactcctgaaataatttcttctgttggagtcctacctcttattagactacttcatagattctagcatggtgataaattttgcaaacagcaataggatgttacagacaggaaacaaaatagatttcagattcttgttaagacaggtatattctagagtgtgggagatacatcttacaaaatttcagatcatgcaaaggtggtgaaatttggggggttcaagtggtctgtatgatttctctttcaaattgaacatcaaaatgatgcccttttcccattctatcactaagggagaagtaagatctcaacatgttccactccagaaagtgcaaagccacgcttcagaagcaaaatcttgttggattttagtgaacatatcctgcatatgattattttcttcaaacccactaccaagtgaaaaatacatctgctggtgtttttgttgggctcaaaaagagagaatttatctggcatttttgtcttgcagctctgatatcttgaccttatttcctaacagatgcactagaaagagaatttgtgctgcaaatgtgttaaactccttgaagtaatcagaacattggtccctagtgatttagagcaaagccatatcctctgtctcagtcagttcgaattgctataagaaacatattaataccatagacagggtggcttaaacaacagacagttatttcacacaactctgaaggctgagaagtccaaggttaaagtgccaactaatttgatttctaatgagggctctcttcctgatttgcagagggatattgtttttctatatctgcatatagcacaaaaagaaaggagtagcaaactctcttatgtttcttattataaaggcactaatcccattatgaaggcagagccctcaccaccttcttcactgacaaaggccccatctccaggggcatgtcaatagtgattatcttcataattgattctttagattacagcaaattcagatgagattatgacttaaagagaagaataaatgtaactccaagattaataaggtgacttattggggttcttcctttgaggataggttttataagtgaaaagcatattcacattggggattaggatttcaacctatgaattttatggggagagacattcagtctgtaacactcttaggcaaataagtatgttttttcatcaagaaacatttttcttacattttcttctttcttactagaccctgggaggttgagacactaagtgattatgaccacattgacttgctgaccattgagacacaaagccataaaagtgttgttcacagaagcaccgcatgatgaagtagaagtggtacctatgacccgcagtgtgagatatccctgaaggagtaagttacgtagtcacgtggctcacacattcaatgtatcttcccctgacacactcacttgtctctataagccccataagcctacacaataacttcatggggaactcctcaggaaacctgatttataagtggtttcaagcaatatacaagtaccagaggaaataggatgaccaacgttacagccccacataggaaagattctgtatgaaagaaaaatcttcgcaatgtcaaaatatcttgtagttcactttatctgaaaataaaaccttcagaaatatggaagaacattcatctgctggccataattaacagtttgactagatggccaaaaattttgaaaggatagagttagaagcatgatgacaagaagcattgataagccatgtgtggaaagacttttcaacatagaccagaatctcagaatatttgttacacagaaattcttacaaaatagcgccggctatagagacctcatacggtgaatagaaatgatccattctctggatgtcattcctccttcagtcaccctgcttcttgtcaacatatctataaaataagtagttgctatgacagggatgaaagttggacatggtgcaaaaatttggacttttcaatccaaagcttatgtagtctgtcttactgctaagcacagtcctacataacagaactggaggtgaaccccaccatagcactatcttttaggaatattagtaaatgatctagtgctagtttgcttacattaaaccactttcattatgtcaggacgagcaacttgtcctcattaaaacagtcacttattctgcatgtaggtttgcccatcatgctgatatgcttttgccagaagaacaatctgagaactaataaaagtccatatgcacctctacagtgtcccacacaacattgtttctgagcatggattttgtgttacagtaaaagaactgaggcagtggcaaactgaggccgtgtttccttataacccatcgatctgaaataattagaataattattacaatggaataaagtactgaagatacaattacagtacaatagaataaagtaatgaagatacaattatggaataaactacagcacaatggaataaagtactgaagatacaattatgactcctgttggaggacgctaccttgcagtctttgggtcttgtttcacagaaggcagaatatacccagagttatgtatacaattcagagttctgtgttttcgtggctccatttggctggtaaccaaagtttgaaagtgtaagtgccacatctctctattacagccaattacattctcataaatattattgtctttcattcctgatggctttggatttttttagtttgcattcctagtatccaaggaataaatgctttgcatcaggagattaataatgggtcagttgaggtggaagttaaaatgtcactttactattttgcatattttatgccagtgaggtaacactccaagttatagctactttatagttactgacctttattatcaaggcaagtgggattactactacaaaatggaaacatggaggagtaaaatagaccaaaaggaaattctattgctatggacagagttgtgtgccttaaatttgttgaaaccctgatcccctatgtgactctgtttcgagagggggccattaagaagggaactagggttaaatgaggtcataaggtctaatcctatagaacttgtttccttataagaagaggagaaaccagagatctctctctctctttctctaaatgtgaacagagaaacgaccatgttaggacacagcaagatgactacaagccaggaaaagaggcctccttagaaaccgtcctgatggagcttgatcttggacatctagtttttaaaacggtgaaaaaaattaatttctgttgtttaagacactcagtctgtggaatttttctaaggcagccctaccagactgatacaccaatgtgggaaagtttacaatgctttagagcaagtagaaatgaaagtttgggtaaccccatccagtatagcttattagacaattcaagtaccggctaagagcaaaataaaaatgtaataaatggtgtagaaggcctggtgtggtggctcatgcctgtaatcccagcgctttgggaggcagacgtgggcagatcacgaggtcagcagatcgagaccagcctggccaacatggtaaaacccatctctactaaaataacaacaacaacaaaaaaaaattagctgggcgtggtggggcaggcctgcagtcccagctactcaggaggctgaggcaggagaatcacttgaacccaggaggcggaggttgcaatgagctgagattgcaccactgaactccagcctggtgatggtgagactccgtctaaaaaaataaaaataaataaacaaacaaaataataaaataaaaaataaatttaaaaaaaatgttggagaaagaaacccattactgctaaccatagtctggtgtctagttaaagaaaaagatatcatggctatccatatattagttccagctctgtgatgcatgcattcgttttttcttttcattctcccttatattttataaaaggcatgtcaatagtgattatcttcataatcgattccttagattacagcaaattcagatgagattgtgacttaaagagaagaataaatgtaactccaaaattaataaggtgacttattgggtttcttcctttgaggataggttttataagttaaaagcatattattcttttggggagggcttacatgaggtataggaatatttcattttgttctcattttatttccatttttttttaaatgtaggtgaatgaatgtatgtgtagatgatgaattagcaaaagaagagttctaaaggatgagggaaatgcatttaggaaaagttagccttcattccatacccttaattggtgaacttttgtgttaagaagagacagaaatgccaacagttacatttctagactctccttcagctggctttccaaatgcaagtcagcttctgccacttgtatatactagagtgagactcctaggaggaatatgaagtggaatatcacttttcggattattttatttctattcttaaagaaaagacataaaatcctgaatggcaaaagccagctatggtggtagttttattaagcattcattgtttagccactagctttgtttgagttgaggggatttgtgattatatggtattctgatccctggatcagagtgagagtgtatcagcttggacaaggttgtattactggaatcctcctgactccaactcctctagtgcttccagtgattttataagcagttattttctactattaaacatacttctgcttaaaatattattgattgtttcattttcctgcacagaactctaaatgacacaaatcttcccccacagaaaaattgaattgtcataaccccctgccccctgaaaaataaatagatatgggcaaaaagtacaattcaaatcagaaataaaatatttttattattgtagtacttaaatgactcacatttaaatttgtcagcaccttctctgagcaggtgaaagagaaagtctcttaagaatgccttctatatattctggaaaaaaaaaatacctggggtaactaggaggcagtcacttgttgagtaaatggtgtgacaagagagtttatgccttatgaagaaatgtggttctttacattgcttggaataatagtcttttcctgggggataagtggataattcacatatagaacaagaggtctcctggaaggaaaagagagtatactctgacccttccattggaagtttaactgcattaggctgtaccaggagtaaaacatcccagctcaagagaaaggatgctaattcgttttgaaacagaattcaaattgagagttgaggaaggcccactggtgacctcgacccaagacatgcacctccatggtccatgataggggcagggctgtctctagctggagaagaatgctagttatcctgtgagtctagaaagttgatttttgatccattttaaattttagtattaaaacagatgtgctgctctttgctctccagttagaagtaagcaggtcttgtgaagtcatagtatcttcaagatgctttagagcccagttatgtatgattagggaatgatttcagcactgagactaacattgataaaagtgatatcaacatgtgtaatacagtcttaactttttctatgactcttgggactcattcaatcctggctagaaggtaggatagatgaataaatggaggcaagagttaataactagcttgtctgaggttgtagataagtagggagaaaattaggcagagcaaccaggtttcctgattaccatctctgtgatctctctactgtcccatttagttaagaggtaagaatcttttgtctgacagctctgacaatccttatgttgccttgtattcactgtgtgacctggggaaaaaatgtttagtttccctaaacctcaaagtcttcccaaattaaatgaataaatgaagctaactacctatttttcctttaatagaatctattagtttcttaccaggatagtctctttgtcatctcgatacatatctcaagcaacttacttcaagcaagacttcctcctgaaaatcttccccttccttacattaccctgtatttgtctgttcttgcactgctgtaaggaaatacctgagactgggcttttataaagaaaggtttagttggctcatggttctgcaggctgtaaaggaagcatagtggcttctgcttctggggaggcctcagaaaacttacaatcatggtggaaggcaaatcatgggaaccaggcacattttacacggctagagaagaaacaaggggggcaggaggtgccgcacacttcaaaacaaccagacgtgagaacagtaccaaggggacactgctaaatcatgatccaatcacctcccaccaggccccacctccaacattggggataaaattcaacaagagatttgggcggggacacagattcaaatcatatcacacccccaatagcgtaactttctgttcgtttattatttcattcaaaacctataagacatctactatgtgtcatatgcattaataggtgtgagagatacattacaaagcataatcatatactcatccagctctcatagaaactataatctggtcggggaaataagttaaaatgtatgccagtgttattcaaagcactggtagtagctcttagaagacagtttggtaatttcagaataccagcttagccttgttaggaattgcctcagcacaagagagacttcttactcaaaggttacaacctttctgcactgtatcatattgatgaaggcacagtcattgtggcccaaagtatgataacctttaagggtcattttagctccagagttccatgtagggttggtctgggctctgacagatctcatatcacagctccacttctcccttctccagaactactgatccctaataaattagggtatttcctaataaatgtcctgcatgctacattctgtctctttcaggtctgtttcccagagactctgaattatgagggttggtaacaggtgcagcctgagattagacaataatgtgggtgttggagttggatcccttattacacaactggcaatgtaagagaacataggtaactcttcttccaggtaactatctaattgttaaaaatctcactggtgttgaactggaatggtatataaaagggaatgaacaagctgatggagaaatcagaactataaaaatgatggtatttggttgattttgctaatttctattgaagatctaggaaactataaataaaggctgaaaatatagaaaattcaaagctacatgtaaaaaacagaaggtcgccttagtagcatacaaggaaagtctcatctgcactgagaggattaaaaaactgagcacttgtccaggatctaccttcagcgaaatctatatctaaaaaaggctatactcagtaatgcaggtgtgtttttgctgtttttgtggggttttttttcatttttttgtttgtttgttttgctacaggaattgctcccagaaacataaagaaaattatggccgatgttaagtgtggttgacctgatggaattgacaaagcagacagtgcgggagggaattgactcaaggaaggggtcatgttggagcaaatgaactaagtaaagctgagtacctaccaagtggtgaatctaattcaaggggaagttgtgcagtttagaacagttaccaagcccatagacaataccctggtgatagggccaccagcatcattgaaatgttttctggtgcctctcatctgtgaaccaggactgatggtaaaattttgctgtagtgcttggctctttgataccaatgggacagtattatcttgagaaaacagggactatgtggcaatgcttgactgccaagagccaggtgttttcaattattgtaatgaccagtaaggttagagtagcagctacagtgtcctaacccatagataatacagcacagctttattagtgtaaaaatatatcatcagatagcaaaggtggttctcagcttgcaccatgagaagaataaaagacaggctattaaagaattaaaggcagtcatcaattatattactttccaagagctgccacaattttccaccaactgagtggcttaaaacgacagaaatttattctctcctagtttcagaggccagaagttcaaaaaaactaaggttctgagagcgaatctgttccaggcctctctcctggcttccacttttacaggcaatcctttgcattccttggcttgtagacacattcatctctgcctccatcttcaggtgacttcttctctgtgtgtatttacatagtcttatcttcttaaaaagacatcagtcattggatttaggcccaccctaattaattatgacctcatcttaactaaaaacttcttcaaagactgttttctaaggatacattctgaggttttagatgggcattaactgtggagcaagcactactcaacttagtacaccaataacacattaaaccccttgctgctttcagaactaagccagttctcagtccagagtctattgtttgaagaggaggtcatttttcacaaagtaagccctgaaagaccaatggtaagtgtacatgttagtaactctctccatcctctccacaatggatgtatagcatatattcagataactgtacactgtgttaaggggaattcccaaacattttcaagaatgacatgaatagggtctggggagacactgatatgtgagaactgaaaagctaccatgagccctcgagggtgttatggggatcaggtaattaatgctggctaaggtctgactctcaatgggtccactagatctggagagtcatgcaggaatattttcttggtcctcagatgtataattggaatagacatattcggtagttggtttaacctcacatggactccttgacctccaggttagggcatataatagtgcagatggctaagtggaagcatctgaaaccacacctctgcgacggtttaaatgttcctgccaaaactcatgttaaaatttaatttccaatataatggaattgggggcagtgtctataagaggtgattaggtcaggggccaagctctcatgaatgattcaaggccattgtcatgggaatgggctcctgacaaatgatgagtttggcctgattttttctctctctctctctctcatacctgtactcacacatatgcttccttgccatgtgatgtcttccccatgggatgactctcacccagtgttggcatgaggctcttggacttcccagtctccagagccaccagccaaaaaaatttatgtgtattataaattaccccatctgtgatgctctgttatagtagcagaaaactgattagaacaactttcctctaccagacaagggcctaaataaaatttaaaaaaattctgggaatggggacagaattagtgtcacacttaaagttctataggttgcaaggaatgtagcccctgtcagatctctatttaattccttgcatggcacctgtagaaatgagatagtttctcaagaatgaaagtagactactgcagctgctgtgtcagatgtgatatctttgcaagggctcattacctcagactcaggtacatggtaaatgattatagcttcggatgatgtgtgtgtgtgtgtgtgtgtgtgtgtgtgtgtgtgcacgcacttaattcttgccaagatatggaatcaagaatggttcacaatcaccaagcggggatgttcttggccagggctatgtgaactctcatgttctctgtcataagaagtccaaagagaaatggaccatctgggtattatacataccacattcatgcattatggcagagatattatgctaattgcaccagatgatcaagaagcatttattctattaaatgaattgctaggaatgtgcattccagagggtaaatgataagcttcaagaaatttcagaggcctctcatattaagaaatattcgacaactcagtgatatttttctcaaggacctgaaaagccactcctttaaaatacagtctccaggaaggttaggcctctgtctcccagtctgtatgaaagaatagaatcctaacttttataattgccagctagcagacacagctggcccaatcacatttacactgacaaatgcgccataatttttcacttgagtctcctcgttctctcttcctactttcccattctccctctaaaacacccagtcacctctgttcaaatcagaatggagctctttcccctactgtcagtagttactttccagtgtcttatttttatttttatttatttatgtattttgagatggtgtcttgctctgtcacccaggctagtgcagtggcatgatctcagctcagtgcaacctctgcctcccaggttcaagacattcccctgcctcagccttccgaatagctgggagtacgggcacccaccaccatgcccggctaattcttgtatttttagtagaaacagggtttcactatgttggccaggctgctcttgaactcctgaacttaagtgatcctcccgcctcggcctcccaaagtgctgggtttacaggtgtgagccaccacgtctggacatttgcagtgctttaaataatgttggatttgtttatctttaacatgagctagattctgccagatccaccagtctgtaaagtagagtgaaaccagaccagtgttttataaatgtaagaattatgtgaagaatcaagcacaagcatgaccagagacactagcaagctgcatgagcaggtagcttctaccctcatagccgcctccatagttgagccagtgtttctctcacagcctgcacctgtggtcatctatgggtgatccctacaaccagctgacagaagaggagcttggtctatggatgtgtcatttcagtacatggctttaagcagaaaatggactgcagctgcattacagactaacactaggatggtgagggaaaatcttcccaatagttagagatgcgtgccaagaacctgatcatccatgttgtgtagacagaaaagctgcattacatttggatatttatagcctcctctgtagttgctaatgagcaggctttcttctcaggggcctcctggaaggaagaagatcagaagattgggaacaaggcagtttgggtctagagacacaactataaatggaatgggagtgggtaactagcataaaaaaactttgtatcatctttgagtgtccactgaataacagtcattatgtaagaggcaataaacaacaaattcaataaaatgaatcagcttgctgatatcagtcagcctttatctttggctgcccagtgctgtgctggcaccatgatacataaacaaagcatccatgatagcagacatagaaactatgcatgtatcttgtagtatgtgcttgcattttcagattgaattttcagcctattagcagcagagaccaaggctgagccctgattttgtttaattcctctaagagaccattcagtcacctggcgaccagttgaccacactgcattccttccaccctagaaggatcagtaattaattctgataggagtaaatacatatttggagtaaagattttctttcctgccttgaagacctagccagcacaattatctgatggtttttccaagtatttaataaactggcaaaagttaccacctaacattgcatcaggccagaggaataccttgctgcaaagaatgtgtgggaatgggccatgatctagaagtggccagactgatagaattttggaaacacctggtaatggcgcagctaaactatgaacttggaagagatattttatgaggatgtgtgaaataacaaatgattcaatatgtacttagaatcgataaatttcaaacggtttattttctccagtaggaagatgactcaagttcaggaaacaagagggaacacagcaatagccctgttaaccgtcactctcaatcatccactggaactctttcgctttaaccatctccacaactctgggttttgcatgattagatgtctaggtccccaaggacctagatacttcccacggggaacatattaggagtcttaattaactataaactatgactgcctccttgcacttgcggtaaatgatctggagtcaagaaaatgagtcatcatctctatgcagataggactgctgttgcacacttaaagaagagacgaatgtagggcactcaaattgtctactggggcagctcctggtactctctcgttcagctttgaccacaaatggatatgtgtactgcccaggcctaaaaagggcacaataagcagagtatcagatgtctgaggatccgagtcacatcatcaactaagccaccagattggttgagctaccagctaaagctagaagactctgtcatgagtaatcaatgagataaatatcagctgtgatctcaaaataagctgaatggctacagattgccccacttactttctttttaaaaggtttctccaaggcaaagaggcccaccagaaacctggagggcttgctccctaagaagtagattcaaacaatgctaaaggtgaactctgacgacaaattatgagcctcacagctccccaaccaggagcacttactttccgactcctggaagtgctgttgacaacccttcagggattgcctcaactgcagagaaggaacatttccaaaatcaccctcttcctgagacaacctgcaactaatgactcatcaaggcaagggtataaaataacagccatttaagccatgtaatgggctatttcggctgcagggcttcccgtggatttggtcagagttgtagtcagcactgcatcgtaattccacttcttctctgctcaaatactctccctcatcctttctttccacaggtgttctaccaaggacactctctaataaatgtcccaatgagctcctcctcctcaaagcctgcttatagagaaccccacctgtaacacacgccatagtcaaactatggacgctgtttgtttttgtcttctctccttacccagatcaaatttactctgtaaaacttcctgcaatgtgacttccacatctgccacattaaaaactcctgtcaggagaattacccatgactcatttatgagtaatacccaggacatttcagaccttattgatactttctaaaagtgtctacaacagttgactccttcctcttttttttttacttgagacggagtctcgctctgttgcccaggctggagtgcagtggcgcaatctcggatcattgcaatctccatctcccaggttcaagatgattctcctgcctcagcctcctgagtagctgagattacaggcatgttccaccatacccagctgatttttgtattcttagtagagacggggtttcaccatgttggccaggctggtctcaaactcctgacctcaggtgacccacccccaacttgacctcccaaagtgctgggattaaaggcgttagccaccatgccccaccccttcctctgttttaaaatgcactaatagcaatcataacagcccattgccttggttttccttctttgatttttctctctcagtattgttttcttaggaagacttcttgtgttcttcttgtcttataagtcttagaatacatttgccatgattttcttctcaattacactttcgctctgaaggatctattcatttctatgtactcaagtacatagaagtctatagctcctttcttaaacagctagctgtctgtgtctgcacttgggtatttcaaaagcatgttaactcatcatgagcacatcttcttctccacccatacacactgctgctttatttccggtctttaccaatcacatagaagacatttctttgcccacaggttttcaggtcagaaaaatggggtggacactgtctttccctctctgttattgcaaccatgcccattcatttagtcaccagtgctgtccttcacacctcttaaatatatcttattgagaataaaacattctgtcctttcccattttttctttctcatttaacaaccatccctcactaactggtctctttgctaatgagcattcattatcttcctcataagagtccacaaatggccaccaggttggttcttctaagacacaaaggaggaaataccacacctatgcttaaagctggacaatgactttctattatgatgacataaacatctcctgactggctcaggagatgttcaaagtctagcccctaccttcttgtctagcttcttatgccactctctatttacatttcctgcctcagccacgctgaaagatttttggttttagttctttgaatattacattttatctcatcactaggccctgccaaatgcagtgtgttctgccagaaactctaaatccattcctgtcctatctgacttctattcattcacacattcagtattcctgtggttctctctgcttccaagaagcttttactaaccaaatgcaggttttcttgatgaggcaggttttcctgatgagtgctcccatcattatccatgatcataacaatcatagcattcttcacacttccttgagaattattcttcatctttcttctctgtttggtgaagagggccatgtctaactggatattcatagtatacactatacctaccaaactctttttgttgggtgaatgaattaattatatctgtgttattccatttctcatgttggtacttttacccctcaattaaagttcccctagcttctctataacatgtcttcttcctttaaattagaaatttaaagaccacagtgaaagctgaaaaatactaggatttattttcctggcaagaaacaaataactccaggagaacataagttttgataatagaagttttaatacttgggtcaagtaaggaggacctggagtattctccaaagcagtgcctgcctcctcgaaggaaagtgacaggaaggttttatggggtgatggaggggggaaagggtgcatcatcgcatgtagaggaggggtcccagtggcaaaaccctagtgggtccttatgccagcacacaggtcacatgttatgataatgaagctatagctcctcctaaggtggagactttagcatggtcctgaggaaagttcactgaggttcatctataaattgttgggagtctgaaagagctggtttaaaacaacaaggagactgcattccacccagggttttggtgagtacaggctgtaggccaggaggctataaaacaggaggattgctcaggtggattaaatttctataatacctggagcctctctccatctgcttacaataaaatctttaaaacagcagttgttcatcctttgtgacattatctttccaatagtacatactcagtatttaaggttatttaaagcaatgcccaaaaaacttaaaggactaacactccagggttatgacttctcatatcaggaccacagttgtaaacctaggcatgtgctaattaaatatgggaacctaaaagtactttataaggaaattattaatttcttctccacatatttttatttagtagattcagattcaatctattatttctgacactccgagagagagagagagagagagagagagagagagagagagagagagtgtgtgtgtgtgtgtgtgtgtgtgtgtgaatttccctgtgtgtgtgaatttcccttgcaaatatgaatgcctcaaacttcagacataaagtaaatgttaggggaattaggatgttcatctttataaaataagacaaggccctagagttacagtgactttgaattttactcttttgtaagaaaatgccctgtatcttagtgtttccatagagaactacagatgctactgcctgacaacaagcctagctcagtggtggccacaagtgtctctgtaagtcacccctcccaactgacctagtttatcacatcttctgagaagataagctattcttagggcacccaggtgcatggattgagcagactttgaagaggcttttctgtcacaggttaacttgtgattaatattaaatattgggttatttcatcaaatttgcttcatagagatttctaaaaggtctgctaggagttctttttttatccacttatatctaggtcatgcaaccttatgaatacaaaatttcataatataaactgaaaagtgtaatttactgttctatattaagaatttttaacatgattattgacaagaaaacattttatgacttgactgggacagttagaagtagattgggacaaagtgtactcatgatactaaaataaagtgaatttgggtcgggtgcggtggctcacgcctgtaatcccagcactttgggaggcagaggcgggcagatcatgaggtcaggagaccgagaccatcctggctaacacagtgaaaccccgcctctactgaaaatacaaaaaaaaattagccgggcgtggtagcgggcgcctgtaatcccagctactctggaggctgaggcaggagaatggcgtgaacccgggaggcggagcttgcagtgagccgagatcgcaccactgcactctagcctgggcgacagagcgaaactccgtctcaaataaataaataaataaataaataaataaataaataaataaagtgaatttgatcaactcttctttaacaaagtgcaagaggctctaaagctggccagagagaatttggcaaagctatttagaagacttgatgttactgtgaattattaggaaatctgtacttagtgggctgcacaggtgattgtgtgtgtgtgtgtgtgtgtgtttgacttatatctgacattgaatggggctctctattgggtggcacagtaccccatgggcaattgcctatgtgtacaacccatagggcaaaaaataattaaaagtcctaaaattgccttcattgagcaatgtcacttctcttttctccctgtattttctattgctaaacttctattataaaacaaaccaagaagaaaagaagcatcattcccctgcttgggccccagttttctgatcctgagagttaaaatggttaattgttaggccatatttctggccatctttctcttattaaagaagataccaaggcataaaaaaagtgtcagaaaagaattttcaaaagcactattagagaggaaacattctttggttttgccctacttctccttcacgtcttccctttttggtcttaaacttaagtttgaattttgataatgaagattgttaatacataggaaagagaacacattactctcataaattgtatataatgagggactgaaaactcagattgatgagatgcctaccttgtagcaggcattcgagtttattgtttcgtgtgaaaatatttcattaacttcccacaaaaccttgcaatgaagacaggattatgctcatcttacaaatgagctaaaaaagattctaagaatttgaaagacttgcccaaggtctctcatctcctaagtggcaaatcatagattaacagcaggactgtctgattgcattgcatgtaattttaattttttcatgcaatgttttcctccttctctcttgaatatatcaatagaaagtactcagaaataaaatgttttgcatttgtgcaataacggtaactaaaaagatactttcacaaaataagctcacagaaataatggcaggtggtccttcactattgactttagtgatgaggaaatggagagcagaaaagcaactttctccaggtctcaaagaaggtagggtctgcagttgactccctgtcattccctttcattccaaatccagctattttttttctacaccatgctgctttcaagcttgtatttaaatgtgtttttaatgaagaaatattcagtttttctttggcatcaaatatcatcttatatgtgttagacttatcccaaactggaatgtgaacatttcgggtaggagagaattgcagaggagggcatatttatttatacattaacagattttgaaatgcattgtcacttctggacagcaggtattttagttgcatctggaatgtattcttgtgttactcatgtttctaacttgtctaaagcatgccttgcccactcatagatgttgtcagacaattcagattagctatggtgccaatgacttttcaaaagaaaattatagtttaaaattatataccttaaaaaatagacctttaaaaaattgttaggtttaatgggctgttttaattattttaatcttgcacttcaggatggaaatcttctccactgccaagttaaatcttcggaagaaaatgaaagataattatcattttatattacatgaaaattaatgatatcatcaacacttacaagttctttcacaagaagttaaccccttgcagtgctttaatttgaagtaaaagtctattttaagcatttgcctgtgagtatatcgttagaattaaaatggggtttttctttatgttaaatgtttttacatggcatcccaaaggaaaataaataatattaattaatatacaagattcatgaactaagagggttttacccctacctcaattcaagtttcccaccttaaatagaataaattaaattttaatatttaggtgaataaataaaagacatacacaggatgaatgcatttcctcaaccaaatatcaagactaggttcaagtgtactatgaagactctggaagtctaatacgtttatgatggttatttttgcttactctctttgcatgcctgctatgcagcagacactgtcatgtgttttcattaattttctctaatttttcatcaatttggggactactatatctacttatatgtgagcaatagacttatgtatagagtctaactatgtggaggccaaaatgtagcaaatgtcttgactgggatgacagcacaacaaaatgtgatcggagattcatttctggatctgtttggctcagatattgatctttatcctctagatcgtgattccaggacaaatcatgaaatttgtcaaaattaaactttattccccacattgtagcatttttcacctttttaattacctttctttgtgatcctttcaggcagaatctaattcaagaaagaaatgtgccagtaatcttaaagaacctaatgtgtttacttttccagtaacatttcctaaaaaaaaaaaaaaaacaaaaaacaacaaaaacttaataaccaaaaaagaactgtgagaagaatagcaaatggctaatacattgtatggttaatacatataatacattgcgtggttaatacatataatatggttaatacatataatacattgtatggttaatacatatattcctaaagtataattaaagaaagttatttaggggatttggtttcccagcatttaactctacctatttatcatgttcattcttgaaagagcaattcttctctttccatcaaatgctgcctatgcatacattcttcagtactgaaatttgctttttgagctagttggtgtttgaggacaccaatactcaagagtctctagtccatttaattccagaaggctgtgcctcttcccccagccacagctgcacttctaacacaggatttgaactggagtccccacagatattgaatagcagggcagcagtagctggtaagattctcaaactttagagaagatttaaaaatgttgcttaatgtttaactttacttgtaatatcacgttttgtttttcccccattgtgatgggctttggtttttaacttgtcctgatgcaccttggcagagtttactttgggagaatgctcttctcgtcctctcttccctaagctcatgatccctgatttcactcacacatcctgactcctatgcttaactaaatcttcttcatgtttgaaagcaattgtacatggattaatatatctctaaaagacagaaaagtagcagaaacattctaatatttaacttctctgcaacattcgatactattgtccgtaatacttcccactcttaaacttgaacttctgaactcacttcctgaaacttgtaataggcagaataatgacctcccaaagacatcctattccccagaacccgtgaagatactaacttttcaatctaccaaaattattggatgtctatgcacaagcataaaagattaccccaatagcatttctgcctgcgttcaggggatcccatctatgggaaattctcataaacatattgaacttagtttgtcctaaataaatttttttatctcttacaaagaccatacttctgctcccaaatgacttatttcttgggttccctaaattgtttggtcgtgttataatctacctaatccaaaaaggcagacatctcctgaatgttaatatgcctctcttgcagaaaattcagtcatttctagcactcaaatacagcaactcttcaacactttcacttaattactgccctacttcaaagtctcattatttctatgctaaaccactgaaaatagtatatcttgatattataagaggaataaagtcattcacttttaaaaatagaatgcctacaatatgctaaagacaaggaggtatgtgttttgtgtgtatggcaactgggatagaatttttttgtggagtctctgtattctccaaggagaaaaaatatagattgatggtggagaacctcacaagggcttaagttcagatttcaagatatctggttgattataattggtaaatttaaataatcagacccacgttgacatttgcagaatcatcaataatttttcttattagtatttcttatttgtttttattttcacagtatcactttgagacttgtaagaattcatccaaactcatccaatgcttaagtatggaactatggctctcatttcagtgttccatttcatttccacaatattacttgtagacttctataaacactcatccaatgcttgagtatggaactatggctctaattgcagtgttccattctatatttaagcaaagctatgcaaaatgtcacattgaactttgaaaaattaaaatgttaataatttttatgaataattgcctaatttgcacaatctttggtttaatttgaatactgtactgattatacaagcctttgaataattcatatgtagaccttctccattatcctgacaatcagagttctacactggttccaaaaacctgccttatgacaatattttctagtatgattggggataaagtatgatattaattatttttgaggaagaaaagtaagtgaagaagagtacctgcagaaaattaattcacaaatttctgtttcaggtgagctttttaaaaacatacataaagatatctttgacattttattttttactgatttttctgtctagttaccttatgagcactgtaaatgtatatgtaaatttctttgtctaacagataatcaagattaaaaacctgacaacacagttgactataatcatagtctttattctctgataggagaggtcttacatgctacttgggtttttgcaaattggatatattgtaaagctttgtttgtaaaattctcaatgtcaggccaataaatgcacatatagttcaaaaaacccagctgtctgctctccaaaaataccctcaagcttattgttagaagtattcagctttacctttaatcttcccatcacctggacacaatccttttagcatagcgagacatccttgcgccagtatagtatagatctccatcctagagaagtatgatccacatgaaaatgtaactcagttccacattgtactgaaatattttactgatatcagattatctggggtgaaatcactctctgcccctcagttactctgagatcttgaacaagttacttaacctctctaaactttagttttgtcatacataacagttggggaatgacggcaataataatacctgttgtatacgttttgtttaagtgagaaatttataaaataaactatattaagatttagcatactacacagcaggagtaaaagccaaataaatgtggtttattgtttcctttattaatgtttcacacacattccttttatctcataatttttatcttttggattatgtctcatctattttgcagatggaaaatggtctgaggaatggcagccatttcttctttagtagttctggattctgacagaccatgaaattcaccagtagataccctaaacatttaaactctcagcctctttattcaactctccccttctcccccactccctccaattctgattcaatatgttctgggagacagataagaaatctgtatttttttaagtcctcccagtagattttcataatcagcctcattgagaacctcctgctcttaatcatgagtattcaacctaggcttcagggaaaccataagcatcctaaatgcatttgtaaagccttgtgtggctggcatttggtcattttcctggaaaaattgtttgtcaaattttagctatcaaaatgtgaaacaatattctaaattcacctatctctacacctggagagtaagacaaagagagagccacaaacttgtaatgtatggatttgatgtcctgtataaattgtgtctaccacaaggtgattttctttacatctgtatcaaaagatagtataatgaataacaccataaaattgacctccttaataagttaaaggtgttttatagaagtatgtcactataataatttttggccttaggaccaggaatacatgattttcttttaaatgttagttatattttccatacaggcatggtgaaacatttttttttcctttggcaaaatccacaactagcaaataaatatgttggaaagagtttacctagtcctaacctcatttgtctttcttattgacttcatcatctattcactgtctattttattttatcttacagtaataaatcttaaagcttctcttaaataagatgtggtgtaaatatgttaatatgtaatacacttaggttttttttaatgttatacatctgatgagtgtaaacattcttaatgaaataattattctaagtgaattacttatcaatgacaaagattataatcaatagaagtaattgattttaattttgtaaaatagaaacataattttatagtaggagtgaatttaaaggttgatataaacttgtttttctttctattttattacacccttacaaatacatgctttattattcaatataggtcctgaaaatactataaataagttaattaaaatggcaaatactataggtatatatattatttaaagtgcactatgttaacattttagatagacaactgataacactaagttttcaatattttcaatatttgagacttgtaagaattcatccaaaatcatccaatgcttaagcatggaactatggctctgatttcagtgttccatttcatttccacaatattacttgtagacttctataaacactcatccaatgcttgagtatggaactatggctctaattgcagtgttccatgctatgtttaagcaaagctatgcaaaatgtcacatccaactctgaaaaattaaaatgttaataatttttatgaataattgcctaatatacacattcttgggtttaatttgaatactgtactgattatacaagcctttgaataattcatatgtagaccatttgtttttctcatttcaaagttttcctgatggatccctataacaagagaaaaattgttctattggggccccaggtccaagaacaaaggacaaatttaaattaatagtaaatgatggttgggtgcaatgtctcatgcctgtaatcccagcacattgggaggctaaggagaaaggctttcttgagcccaacgtctgaggctgcattgagctgagatggtgccaatgtattctgccttggcaaaagagcaagaccttgtctctaaaataataataataaagaatggtcatgtcatttttatagaaacctagaatcatgtcatttttatagaaacccagaacctagctgaaaaattgaccttttttgcccatatatatctgttactatatagtagacaggattatttcaccagtggagaaagtgtgatgttggctaattaggatggtatctttacttgggaaagaatagaacgaaagagaggatagcggattaattcctgaatcaagagatagtgacaggtccggttataaacactcataacattgactgacccatgccgaaaggtatattggtctttgtgatagctaactctgtgtttcaacttgagtgagctaagggatgcccagatagctggtaaacaaattatttttggatgtgcctgtgaaggtgtttccagaagagaatagtatttgaatcggtagactgagtaaagatgatctacctttgccaatgtggctggaatcatccaagccactgagggatggaatagaaaaaagaggtaaagaaaggacacattctctctctccttgggctgggacgttcattttttccctgcccttggacatgagagctcctggttctctggcctttgaatcccatggcacagttctcaggcttttggcctcaaatggaattatacccctggctctttcccgagtctccagaagttagtatatcatgggacttcgccttcataattgcatgagcaaattctcataataaatctcctcttatgtacagttggtcttctgtacatatgagttccatatttatgaacccaaccaaccatagatcaaaactattcagaaaaaaatgtaagaatgaaatcgtaaaatataatacaaatttttaaaatatggtatggcatctatttacctaccacttagattgtattgggtattattagtaatctaaagatcattcaaagtatatagcaggatttacataggtcatatgaaaatacaacaccgttttatataagagacttgagcatccacaaattttggtatccatgggggggtgtcctggtaccaatccctgtggatactaagatatgactgtatgtctattgtgaacccaacagtatctgagacagatttcaatcaatttagaaagcttattttgccaaggttaaggatgtgtcggtgacacagcttcagaggtcctgacatgtgcccaaggtggtcggggcacagcttggttttatgcattttagggagacatgaggcatcaatcaatagatgtaagatgtacattagttaggacaagaaaggcaggataacttgaagcagggaagggggcttccaggttacaggtagataagagggaattggttgcactcttttgagtctctgattagcctttcagtgaatacacaatttacatagaggagggcagaggaatagtcacttatgccttagtctggcttagtgaagcaatagggcagaggaagccgtcagatatgcatttgtctcagatgagcagagggatgattttgagttctgtctgtcctttgcctacgagcaatttccttgtgcgcaaactgtgaggaaggtatgtagcttttttttttctttttttgtctttgtataatagctatcttatttaggaataaaatggaggcaggcacttcccagcttgacttttccctttgatttagtgatttgggggtcccgagatttattttcctttcagactatatatatatcctattggtctgtttctcaggcaaaccctgaccaatacagtattgaaatattaaaaacgaaagctcacagtatctctcgcccatctggctttagccttataaactgcacatccaccaatcttgtcttgcactgaatcctgtatggacattgactcaataaacatctactgaatctaccgaggatgttgtatttgtaagttattttgttaggctctcttctgttttggcacaaataagccaatgtcaatgagagaaataaagacaggtagagacaaagaagaagatacaaaaacagagaaaaaaaggcacaaaggcacaaagccagctgagacatagatagagaaatagaaagatcagtaaggaattaagaggcataaaagaaggtagaaaagaatgtgagaaaattaaagaggaaaagaaaaaagttcatacagtacctgttttacatatgaactaccaccaccaacaaaaaactaatagaatttaactggtagtcaagctctgattacaaacatattttttgggaaaagaatagtagagtactggtggcatgattataatcacacaaatgccattatttcatatgcatctattgctgagagcaagtctcttcttcattttatttgaaaatttggtttataatatgcagtgatccatcatctgtaagagaaatgtgcggaaagataaattgtacagtggtctgacaaatcttattaaagtaacatatagaagaggaaaaattaacagctattccattataaatgtcaaatccacagtgccactttcttcgtaactattgtatttccattcctttctcattaattcttagtccttatgaaatagttttcattggttgatcagtcatgtatatccataaacttctaatcaaatatgtcactattgcctttaatttataaacattattgcaaaaagtcagtgaaaattttgtttctttctgaaaaaagtggacaagtgtatacctaaaattaatcatactggtcttttaaagtattgaaacattttccttttttttttttcaaatttggtccacctaattaagtacattgtcaaaagaacagaaaaaaaatcactatattaatattttcagaaagtttacaacaaaataacttactttatattgtctaaattttttagcgagaagattgatatttagatgatagtctgattagcctgttggtggatgatgtttattgatatggttttgctaggtccccacccaaatctcatcttgaattgtagctcccataatccccacatgagggacccagtaggagttaattgaatcatgagaggggaggtttcctacgctgttcttatgatagtgaataagtctcacgagatctgttggtttgatagagggtagtttccctgcattcacacactttcttgactgccaccatgtaagatgtgcctttgctcctccttcaccttccaccatgattgtgaggcctccccagccatgtgaaactatgagtccgttaaacctctttttctttataaattacccagtcctgggtatttcttcgtagcagtgtgaacatgggctaatatacattagtactgtaacttttttacacagcactttttttcactctcctttcttttggatctgttggtgaataacctgttttcatccatgtgaggatatgacagaggcagaaactgtcagtcaggattttttctaaatagagtggattgaaaatagtcacaaatactttgctactctgcccactgagaagtggaatttaatttccattctcttgactccaggctggccttagtgacttgcttgaccaataaaatacaatagaggtgatgctttgccaatctggggcctaggcttcaggagaaatgacagtttccccattgtttacctggaaccatgagtgaccatgtaagaaagccaactagcctgaatagtatgttaagaataatatgttaagacattgtaatggaaggaggagcccccaccacatagatattccacatggaagcacccaaatgccagtcctattctaacattaagcctcctagccatcttcacaaaaacagcagatatgtgcatgaactcatcttgcattctccagtcgaggggaccagtcagctgaacactaccaaataacctgtgttaacacaactttctataactttcttgttaatagaaaattcttgcctaaatgtatgacctagaaaattgtaagatataataaattccatattgttttaagctacaatattttggggtatggttatattaggtttgataaatgaataataaaagcaagatattgtctttctgctggagttgtgaaatggagattacctgaacatacagaaagcaagctggctagaggcatgcccactcattaattaagtgaaacccaataaattcatttgggttttaatacttacaaaatcagatagcttgacttttagtatttgtaaacttaaataacatgattggcaaatcatctttataataagttaaaaccccaactttgctaatattagtaatagttctctagtagctgtaacttccaatatccatagtctacaaacacatgatacaaaataacacatttagggacattttgatgtcaataatgatgtggaaaattccatagaatttgcacatcccttcattagatatgaggtaactcttactagttcagcctttatattattttactatcctgggtgagggcatttcttccttcattttttgcttccattacaatgtcttaatatacaattcttgctcattttctcttttccagatatgaaactgcagtgattatttccctataatttctctatttctctcctatataaacttatacctccaatcactaacaatttttctatctccacttacccattttcaactactttcttctatttttaataattcttataacttgcaacacaaattgcctaaaaaaaaagatgttttaacttaatttctttttctggcctctctctctctctctctgtgtgtgtgtgtgtgggggggggcaatgtgggggggttctcatatttcactaattagtgtttgcaaacactgttcatgctttatcgtcatcatcaccatcatcacctcttatatgtatttgcacttaaaccattctatatgcattcatttaatattaataaatctatgaagtcaatgtcactattatatatttttacagatgagaaaaataacatatagaaaggttaaataacttcccaaaggttacatgttggtaaattaccaagattaatgaagatatgtcaaatgaatggaaatggctctcatgccaatcttcctgatcattctcctcaattacaactgttattctagttcaaattgttgttacctccatccaagaattttacaaccagctcctactggaagtctgactctcagatttaccttctgctaatcattattcaacagaaactccagaccaatattcttacgtcgcaaatgttatttttgctactcctaactactcattttgatggctcttcactgctcacattgtttatttgaagtgtggtgccctggtattacaggcctacatgcatattttccctgtagtttccacagtctattcttttggggacaaatacttagtttatgtttgacccaacgaggttaatgtttccacagatataaagcaagaagaatacgttatagtaaatataaattgtacaaaacaaatttcacattgtttttctaaatattaaatgttattagttttatgacattccatgtacataaggataaatgagagataagtattttaaattttaattgtaagacatattaataaaaaaggcatttatgaagtatttattaattaagtagcacacttctgctcatctgtgttgaacatcaggaacaggagatgggaagagtgagttaagtgagtgttagtttgttactattatgctgatttccagaagtacagacattgactgaatgtaggaactcaattaatagcaatatctgtaggttttcttctatttcatatgtttttcaagaataaaaaatacatttatgtcagtgattttttcctttattgggatattaaagaatcttcaaggattattacagttggattaaaacaatatttttaaaaatcacctatcttcataaaaatgtgaaaatatgtaagatctcaatagttacagcatgtcttagtacattttggtggctatataaaaaaaccttacactaggcaattttcctttttttttttttcttgagacagtctcactctgtcacccaggctggagtgtagtggtgccatcttagttcactgcaacctccgccacccagcctcaggtgatcctcccacctcagcttcccaagtagctgggatcacaggtgcctaccaccacacccagctaattttttgtatttttagtagagacagggttttgccatgttacccaggttggtctcaaacctcctggcctcaagtgatcagcccaccttggcctattaaagtgctaggattacaggagggagccaccgcacccagcccctaggtaattgttaaacaacagacatgtattgcttataattctggagattgggaagtccaaaatcaaggcatcagcagattcggtgtctggtgagggctcctttctcatagatgtcaccttcttactgtgtcctcacatggtaggagggaagagggcaaacaaacagccccaggacgttgctttgtaagagcactaattccatttttttttttttttttttttttttttgagacggagtcttgctctgtcgcccaggccggactgcggactgcagtggcgcaatctcggctcactgcaagctccgcttcccgggttcacgccattctcctgcctcagcctcccgagtagctgggactacacgcgcccgccaccgcgcccggctaattttttgtatttttagtagagacggggtttcaccttgttagccaggatggtctcgatctcttgacctcatgatccacccgcctcggcctcccaaagtgctgggattacaggcgtgagccaccgcgcccggccctaattccatttttgaaggctctgccctcatgacctaatcacctcccaaagaccccactttctaatattatcaccctggtaattaggtatcaacatatgaattctgaggtggggtaatacattcagaccataccacagtgttatttctatgagaagcatgcatctttaattccctgccatcttgaagagtattctgaatcttagtgtaaatagtgggctgtgtataaaaccactaccaatatcatatcaccactcaccccaatcctagaatgtgagatctaatgagagctattgtttttatagtcttatttgctctcataatactaagttgaattttaaacagtgtatatcaataagtatatttctatgaagatagaaaagtacatcaagaatgattgttgcaatgaactacttgtacaaatggcatttaaaacacacttggaagggtgaagagagtggctgtggctcagttgcttcttgagatgactgttgcctggactcaaccttgacggacaggagaaagtgaggaggagttgtcagagttatgagtgaggttggaggaagtcaaggtggattcctcataaagaagagcactgtgcccctaaagagacagacaccatgagaaacactgtgacgttggacatctacatttcattattttaaaatgaaaaaaatagcatgagacaatgggaaaatgataagccaagtttaatttttaaaaaaagcttttcatgtcatgctaaatagcttagattttaaaacagagtgataaaaacttcgatgattttaacttgataatcaatactatactttaaaaaatcactttggtgacagaggagccattcatcacctaagattgggtatatagcagccaaatatgtctaagtgagacagaagaaaaaaaaaacgagagagagagagattctaaacttggcagaggacagctaagatggtgagaaggatttgaaagacaggaaaaatatagcattgacagaatatgggaacctcataaatgttactcaggggaggctgaggagtcaaaatgccatcagggagttctgacttaggttgggtcaatggtggtgtaatattttgaaaatgggaatatggaagtagaattaggcttcaggagaaaaacattaatgtatgggcacattattatcctaatgttgaggtctaagggtaggaaatttttttgggaatgacttgaaggagagaaaaggattaaaaagaaattaacttttcttgctcacagatacttcccaggtaatcttacagtttttcccaattgttaaaacttttatgttaacacctgtacttttactcataagtaaactgaggcttaaaaggaatacataattcagccctaatcacacaaatcgaaggtcaaaacttaggagtcaaacacagttcattgtggcaaaacaaaacaaaacaagccaaaaacctttcaactatacctggaggcagaaattgaaacattacctaggtagcttaatgtgatttacaaatctggaatcttggttattcatccatttagaataaatcttggtgtaaaatcatgcagaaatctctcagggacccttaatcatgtctctcacactaattttcttttcttttcctagtttctgttaaattattatgcaaacaaatttattcaaatgcatttttcgagagcagaagaggggtctgggattgcatgtacttcagtttgaaagataattgtatctcatagtgaaaatgtcttcacttgtaaatcagaatgattagaaaaaattaaagatacttaaactgtcatgtaagaatgtacaaataaaagaaaagaaaattcacctaaaattattcgttttaacctggacattgtgtttaagtgatggctagaataacaacatttaaattacaaaatgtgtttaatatccgaaaatgcccatgttacactgcaaagtggaatgttataatttaaaaagagcatgatagacataatctaaatgagtttcattcggtcaaatacaaatgaatttagactagctaagcctttgtcatgaatttttggggagagtttataatgtactattaagaaagaattgtttgtttcaatttgtcttgggttaaacataatacaggaagataaacattgagttatagcaggagatttccatttctgagaagttttatttttgtttcaatttatatgtaaatttacacttaaagaaacatacatttataaacaacaacatgaaaagtttaatatgaacttcaaatgcaagtttatgcagaaagatattcatataccaaataaaaacaaaatacttaaataagactttaaattcttcgaagaatgtattatggataactgaacgtgtggaaatggctaagcataaaagctttgcaatcaccttttacataatttattaattagagttcacattacaatgtgcatgcatgttacactccaggcgtgtaaaggtatgaatgctgaaaaccttaataaatatcagtttttgacactagttaccacattaatgtattttacaggcatcatttcattttattgcagtctaaaatttgatgttctctgggttgaaagcaaactatcttgaccaacatggcagcctttgtttatcccacggtcaaactagttactataattctctccatctttcttcatccactgctattgttcttttagcttgatttgatattttcttaaagcttttcagatttattttaattaacatcattcttttttcaaaatgatagactggacctagattaccagcaggacactgagaattttaggaaaaccaactgtcatgtttagagttcatagtcctttttgtcaagacaatgtacaaaatgagaaataagtgttttaagagagaataaaaagctatagaaactatatcacattcagattataaaacattttatttattgcattctgctttatagaagattttgtttaatttaactagacagtaattgggactgaaatatttatattactcattattttagaggtcagataagttgtcctattgagcacaagattctctaagccctgcagtagttttggcctgctcagaatttagtcaagaaaaagatgaagataaggtagtcaagaaaaagaccagtcctgaagacatcttgtgtctcaatgtccaacttaatgagtgtggcagctctatctatctatctatctatctatctatctatctatctatctatccaaatatctatctatcatttttgtacctacctgtctcctaatcttctctcctcattgcatcatcttttggaattctgtcaatcaagacctgtgcagcctactctaacttgtgatatttgaccctaccatttatctatttattttggtttggttttaggtattttattctgtgatctcaagggcacagatatatcagaaattaaatgtaagggttccctctgggtcagggtctctagtaatctttgtctaagatgttacttaatcagccaatttactatgatgaagaggctataaagattagcaaaatcgtaagaatcccaactgtttctgcacaatcatagacctatagaaagaagaaatcaaactctctagacttgaacataaaaaatatttgataccataatgttctccatgatctggaccttacctctccaccccaacaattccctatcactttcacttgtgaccgccaaactcaccacacactagacacatctgctttccctttgttggccgatatgcatgaactcactctcccttagtgtcctctgtcttgaaagcatctcctagatcttcagaagactggcttatccttgtcattcaggttttgccatacatataacacctccctccactagcagaatgtttttttttctgacatgacctccaaatctagtgtagtattcaataattctcaattccatcatcttgttttattttcatgctagcatattttcctatgttttattttattttctctatcccctgccatccaaatagaattcagtacctaatcagtacttggcctgttttagttgctcagaaaattgattgaatgcatagacttagttagcaaatataaaataaagggatagtatttaaactcaaacttgacaattggcattttccaacgttttatgcattttaaaacattttataagaacaaagaaaatgtataataccacctagccacacataatccttacaaggcattagcaaatggaaagaaatatagaaaaaaataatgacaaaatctaattgaatagcagctcactacagctgttgctcagcacaacttcaattttattagattatcctctttttggtgttcccgacacattacaatgactcaccatcagaccccaaagctgggatcccatgtgtcctgtttctaattatattttggtaatgctgttatctccacttaatttcactacttcacctaccagaagctaaatcaaatgaaaggattccaatttagaaacaactttccaaaaagaaaaggaagagtttctagctatttgtacatgtagactgtttccacatgataatatcagaattatttacaaattcactgttgcttgtcagtgaaaaagtaggggattgagacaataaagcaatggttcacagagcaagagggaaagtgggagacggttgacagagctagaaatgatgttctcaccacctcatttcttgcaagaatgaatcaatagaagaaacatatgggatttgtctctgtgttgagtatttccacatggtaatgtcaagtcctgtaaacacacaagcaacatgcctttgaagatcaaaagaagccaagcaaaaaagcaacttagtaggaattggcattctagtcataaggagtctgtccatcctttctgaattccttttcttcatttattccctacaatccacacttcaccaacgtcatttcctgtcgtgtgattctgtggtgtctggataaactatattacagtttctggagaaagagtctcctgtttacacatcttcgtatcacaaacaacagctgatggttttacacaattaaatactgatggacctaattaccacatagtattagttgattagagtcatggcatttcttacattatcttggtagaaagaaaaacacatatgaagcattttgtttattcctacgttcaataaattgatattaaacttctcttgtgtgccaggaacagatataagcactagagatatagtatcaaacaaaacaaacaaaaacccttgcattcctcgagctcatactctagtttaaaaggagagacaataaataaaataaataaataaaccgtataatacagtacgtggtcatagagtcactgaaacaaaataaagcagagaaggggatgggattgcacttgggttgtaattctacttcagggtctttctgtttgcttgcttgtttcacctatgcagacttcttttattaacctccaaaagactacatgtactttcctaaagtactaaaagaggttaatgaagctgcaaacccaattaattattgattccttcaaggcaaagacaaatgtcactaacaattttttgtgctgcgagtccgtttgtgtgcgtttgatgcttgaggaaatggtataccacttatacctcaactacgtattgatctttggctggaaaaattcacatataattttatcagtgcaagtaatcattttttatttttaatttattattcaaagccatggcatgcgttgatcatccatgataccagcattaatacgtgacaaataagagttaattcctcaaagcatcatttttctgtcttcccaccaaaaatagcactgtcaactccagctcttctaacagagaaagtagatttttttctataaaatatgcaaatctgtgccatggaaatctattcacacatattataaacttaagaagcattaatagtcaacaaaaaatgaaaaaaaaatagaatttttaatatcaggtcaagggcatacaagtatattatcctcgttgtctagagtggagggacttcaaggcctgtgatgatctgagccatctctctctctttctttctctctcaatcaagcaagcaataaaacaactgcattgcaaaactgtgttagtacttatatatgtgaattaatttggcatcaataaaaatatgaaatctcagaagcactgaaccttaacattggataagaatatagcagtagatatagagtcagtagcaatgaatctctgtcctaaaaatatacgagaagaataaatacagataggatagtaattaccaaatgaacaaagaaaattactatgaatttttcatttttggccagctctgtgattttgaactgttactttatccttgctaatttctctatttttgatccaaatttttgttaatatctttatgagcctaggtctaatttagtgagtaggcttagtttgagatttgtaacagatttaatctatatatactttttgtactcactttaagagcattctttaagaaccatactaaaaaaaaatgctcagtttatcctgatttttttttctgtttgtaacaattattttagctttatttttcttttttaaaaaatatgtacagtaatgtttttatacttacttttaaatagttgtgtacatattattctatacctcttgaatgtaggtatttccattgaacttagagcaatagtttatttttacaaacagcagtaaatcagagttctatataaacaggtaaaaacaaagtgaatgaaataacaataaaaacggaatattttcagggagagagctactgagcaaaggattgaaattgtactacatttaaaaataattcttaatatgaaatgaaaatttcacaataaatattggaaaacatatttcttcatcccataacttgcaccattattttgctcgaattgacagaccctttttccagtggatataagcataggggtctgcccattactgagttttccagtaatccaactcttcagcatcacagccagtcagcatttttcctctgctttttccagatggtaatgtccctggcatttctgagtcttcccaatgcaattgctcagtgttccacataatgaagaagaaactctgcagatacctgagcagcacattagttgctttgacagattagcaaatccagcatctcaaaaagggagcgtgctttagaatctcacacccaacaccattttggctaaaaagaaatatataaatatatctatatctatatctatatctatagatatatagatatagatatatagatatatattgaatcctatttctgttaaaagagaaaggcatggtttatattttataaaattattgtttaataaaacaaagtaggtctgtcactcacctgtggttctcaattcttaggaaaattgaacatgatgagtctgtcacgtcccagcaatactttgcaccatgtagtgagtgtcttgtcagcaaaataggaaacagtgttgagaaagtcactgaaatcattcagctgtactggaaagtttgctctttgttagcaatgccacacaggtttctccctcaccatgcttttggggatggacaaaaaatacctatcaggccagtagaaactgcttgggcaacctgtgagggaacagctggcatgttgaagcagttctgcagcgcagccagctaaggggctgttctcaaaagcaattcccttctggccggctggcccagcccaggaagtttatgacaaccacagggccctagtctgcttcaaaaaaacaatcttgtaacaggagtttgtggatcatgatttgtgtgaattaatgagtaccacatctctttgcaaaccacttggcctcacagagttgagcccgttcagttgcttggacatgcaaaagaaaacaggtaaacaaaatgcatcaaataatctatactccttttgaggttttaagagtctgtgtgttggcatggaaatgtttatatatacagagatatatatgtaaacatagacacagacacaggtagccatcgagttagagacagagatatatccatgtgactgtgtgtgtgtgtgtgtgtgtgtgtgtgtttatgtgtgttggggtagtggagggacataattgtgttcgcatggttgtggaaagaccagcatggaaacattggtagacttccatgtttaatctttttaaagatgactcagcctgaagttaacatgaaaacaaagactactgatactcaaaaggaaaatccatatcgaagttagaaagtgacacatcttggctcaggatagcatctttcatgtcattatatccagtacttgcctcaaaggtatcctttttctagatgttgattgaatatatggcttgcttactggcttgcaccccattacagccttaatgaacgtaaagatccaacataaaaaagaaaataattgggcagacattaaaatgctggaatgatgttactaactatgcaagggtgttgtcactgcctttagtttgtcaatttgcaaaatatttttcttgcaacacgctccattttttgtcattttcatatttggggaactacattataggaaattacttttgtccaaatgtctacaattagtgaaaatgtaaacgttggccctcaaatattttaactacaaaatctagagatatcttaataataacgaattttgatgaaaaatgctgtcgtgttctataaaataacttgtcagtgcctttttatcattcaatagtgatcagataaggaatcagttttctttatagtttcaatgaaggcatattttagattagtatattatttaaatgtgcaaactacaaattgacaacatctggtactttaatgaaagaggatatggcactggttgtaagatcaagcttttaggatttgacacaggatctttatgcattaaaaatagcaatgattaattcaaggctgaaactgactgcagtttgatgccctttgaactttgaaatgagaagatctgtagtatcctcttaactggtacacaaaagtaacagaaatgaataatggaaatatgacatactttaaaaatgagaatagctgcatgattaataaattttgcattcaggaccattaaacaaaatattttttctaagtggtcattgagatctaatatattactgactatctcactataaatcaatgatatttcattattaagattattttgaggtaagttatttgttcatataacgagattcaaaaataacatgttatttgaaagaaaaattatatgacattgggcaattaaacaacacaaatatgttttacatatacaagtgaaaattaatataaaataatattatctataggtatctaataatttcttcaaaagtatttaaaggaagacaaaattatttttaaagattaactcaaaagaaagccataataaataacaaattttactcactaattagggctctgtcagttggtgagaaatgcctcaatatacatttttcttttactaagcacgttataaatataattacatttcattaccaagaaaaaaatatatttaacctttttatctacttcaagtgagtgtaaaaaattatataaagctgaaacctttatttgttgaaagcaacaaataaagaaagtcattaagataatggaaagaaatcaagttttttgtccttaccaccaatttattaatttattcaacaacaccttgaaacaatctatatttatttctacatctgaaatgtcattaaaaatcacttctaagagctttacaaacagcagggaaaaaattttgtaaagaagaatcaataagacaataaatatggaattttataaaattttgattttctttacaatttcaaaaggtattgaaatatttttattgatattagctgtgtaatctgaaaaatgcaacatagtttagtacttaaaagagggcatcataagtcattaattttattcccaatttctatatctctgaaatgctttcagaatagcttcttgttttttttttttttttttttgagaagaaatctcactctggcacccagacaggagtgcaatggcgcacaatcttggctcactgcaacctccacctcctgggttcaagcgattcttctacctcagcctcccaagtacctaggattacaggtgtgtgccaccacacctggctaatttttgtatttttagtggtgatagggtttccccatgttggccagtctagtctggaactcctgacctcaggtgatctgcccatcctggtctcacctgcccatcccaaagtgttgggattacatgtgtgagccactgcgcctggcagcttcatatatattttttacacagggagaaaatacggataataacatttgcttcttgtcagaaaaaaatgttctaaggattcacaggctactcttaaaaagtgctttgaagtctgtaagggaagagaactgtgtcatttatagctatcaaatattacttcaaaactgaactatgaatctttgcttatccagaatttcaaaattaatctcaaaagaaaagaactctacatagcatttttttcttggttaaaatgtcatgaacttggaaaaagctttagtgtttttggaaaggatccatatctgaacaaattttcagagttgaaacttttggaattgtctctaggtattttaaataatatataaatattagtatacaagtgttgaaatttttgctcagcaaaaaggtgggctgtgtcttagaggacaacattagcactaaggagagataggtcatcttccatgagctcccaaagctctctcattttatcccactttactgtgaaatagtgaccgtatttccaacaagatcctcaatcaaatctgaaagaatggatgacagatagatattgaatgtttgagtatgtaagaatgtagaaagcaaaagaatggtgtatattagtgtcttgcacttatgcttcaacacattcaacccaattacaaacctcttagaatgaattattaactttttcattgaagaaagtgaagtaaatcatgattaaataaattacggagggttacagagttaaacagttattcactaataggtcacctgactctaaatcatttttacttatgaagtaccaactaggaactagataatgttgcttaagatcagaatgctttatttgtagtacaaatgattgagctaatttgattaccagagataaaatatttcacttaacacaatgaatatatatatatgtgtgtctgtacgtatacacacacacatatatatgtgtgtacatatatacactgtgtataatttatatatatacacacacataacctacacacacacacacacacacacatacacacacacacacacacatatatatatatatatataacttcactcttttccctgataacactttctctatcttcctgaaacatttagaatcaaactggatacctggccaaacagaaaattacacagaggcatgagctaagctctgccacatggtttcaaatgcataagtgttcaaatatagagaatcacaaacatctggggaatatatatgtgatctgtctgtttagtatgtgttgaaaaaattgagtaagattacttctctgtttgttagtaaaagaactatgtagttattttattttaaaactattggtaagatcatcacgtcctaagtttatgctaacacaatcacagccttattgcctcttgggactgttgtaaaatattaaaagggcacatatattgtacatgtttgtggactagttacctagacatttacatgtgagcttttcagttaagcattccatgctttccggcttccaacattggtgcagtaaaacatctgaggaaaaaaaatttccaggtaaaagaactttacaatatgtatcaatattatatctgcattttccactcatttccctggggtataaattgaatagagaaaagtttcttatattcagctaaagatccagttaagcacactaaagtacattgtcaggcattggttaaacttaacttcctgtatgaagagaatatctttttcaaagtggaggtattttcccctgtgcggtcatagttatataatcaaattctcttttcccttgtatgtaatatgtctccacactttaatagtcatacctatttaagtaaaataatagatgcttttgatcaaacaattgggatactgtataaagcttgagtaaggaaagagtccagaaatcattgagctaaatacatagtttcaccttctggaaaaatcatgcccagggagactgagtggactgttctaagtcacatggtagtgatctagtcaatagccataggaattgtaacaaagtatcctgatccctagactagtatctttcctcatgttataaataattttaggtaataagtactgtcattagacacaaatttaaatagttttcagatttcagggaaataaaaaaaatacatccttacttgcattgactttattatgataacatgaaagagaactttaaaaaaattggaatacttgaggttaattattttttaatttttaattttttgagatggattttcactatgttggtgatacaggatgtttctcagtcctgctttgccagcaggaaacttgtggccagtagggcctcagctcatttttcctaattgccccactccagcctgcagctcccagactggcctggccttacctctgtttcccatctcatggggacgccacctggcactggcaaaggatggcagggctacagcttacagctccttttgccccagctgttcagcgggtcccaggttcttgtcctgcatccaagaagaatgaggttatgctgacaattgaagggtgaggaagacagggaaaaattttactgagtgacagaacagctctcagtggagaggggatgagagggtgatcccccacctgacgtcagatggtttctcccccagtatggctgggtccagggcttttatgggctgagaattggggagtgcatgctgattggtttgtgagtatgcaaaaaagctaaaacaaagacactactcaaaggtgggcatgacagcgtaaaaaaaatcagttagggaaagttaggtatatgtaaaataggtgaagggtgaggatcaatcagaggaaagtgtgccaaatgggaagtgacattcctaatctggtccatggatttgacttctggcttggctttcaggctttaaactgtctttggcttgaaggtggggtttcaccagggaccttcccctatctgcctaggcatttgactgtttcctgccactatcaattttcccctctgaagaggtacatctaactgccattaggacggggacgatgactgatcttcactgctttctgctgacagggggcactgttttaggaagacagcagtcagatctccctcagaggcctgtctaagggtccctgttaaaagagaggcatcatgtggggctcccatttgcatgaccatttagagtctgatggcctaaatgcgagaaaagacaaactaggttattagaagacatggatcaaaatgaaacaaggggggaaggacagcttaaaaatcccaaggctgccaacatgcccagataactggaggctattgttatacctgctaagacttgggtgcatgggtcatggcttggttagctccattggtcttattttccattatccatccattttgtttcatctgagctacagccagagatcactggttggttcacaggaataagcagggttagtctaaaatgcagacaagaacttaaagacaattaatgatactagaatttaatgacaagtgtatgacaagttttgaaacataattttccatctccaattcttatttttgttaaaaataaatcataatagaattgatttgtttgcaaaataaactttagtcttacatttggcctgattatttgcataaagtgcagcaagaataaatattttcacataggctttttaaattggctcggatggaagtctgttccataaggaacatcaggtaagaatttttaaagccgagcccagccgtgggttttagtctcaaatacctatgaattgggtaaatttctctcttcttgaggtcacaagataacttggggctcctggacctgtaaaacattacattctttacttaccaccagttaggaaccccgtacaggaactgtgtaaacaaggtatgaggccagttttcccaaggggcttttactgactctgcaagtcaagcttgattccttacagggaagcacattattccagtcaaagccttgtcagtttctccaattgtgtgctgttgcgaaagaaaatggattcttattgctcttatgcaaataactacattgtcataagttgagaatattcaccaatagtttctacgttttgaggaaaccagacagagagaaacaaatatgctccaaattttgttcacaagagtataccttattcaattcttaatagctgtaaatagctcaaaataaaagtttccatgactctgaaaaacagtgtttcaagcaaaatgttaaaaagatttatttagtcttctgctaatttagtccatttagttaactcttgttctgcttgttattaatgaacatttcagttctccatcagtcctaaatgtttttcctctcttcaaatgtcataatctccaataagaaacgtgcatttgagagcacctgtcaaggtcctatagctgattatacaccaccttttgaagaggattaaaacaagataaccattgtctgtgaatgacaaaattgtcttcaggtagtcatagtcaaaaacatgactgacaaggaaatttggttatttatgtggtttacaataacttaacctaataaccttaattatgaatgataggatacactcagacattacagttttagaaatctcatgtaactaaacatgtcaaataatcctgtttacctctcttttggatgcttcaggaaccctctgtagtgtccacaagttaggggttagaaaagacaaatttgaagctgaaatttgatttttggaatcccatcaaatatgttaaaggtttaaaactttatattatccttaaccagtttgaccatgaggggagattcttataaaccttttataacccttcaaaaatttttgttaaagtgtagatctgtgtcttaagaaaaccttgttgtgctttgatttcaatgttcagtttacagaaaaaacaaataataccattttgagtttagtcaatatgttcatacaaagaattgcttttacaagattaatttttacaaaccgtccacaacttattcaaacctttagctttatttaatttgaaacaatcctttaaccctctaaatgaggcaaaaatttacattcccatgccttcttataatcttttactaaaaacacattctactttccttacacaacttgcatgtaaatctatcttcagtagtctcaataacatgttataatggtaactcttagtaatttttaattttggtgtaaaacttggcaagtcattttaattatgtactaggtgcagataaggtctgactcttttcagcatagttaggggcatggttaactccaaatgactctatgccttatcaaactgtaaaacaggcaagtccaacaattttcaaaagccaaagaagcagcttataaccttaaagcatttaggagacccaatatctgaccatgtaatttagaccacatatttacattttgaagacatttttactttgccaataaccttgaaagctgcttttatttctcgaagattaaagtcacatgaactaaaaggcattacagcttttatttttcctttaaaaatatttgatctaagtgcttatgttttctttaagcaaattaattagagctttttaacaatataaacatgatacaaactacacatatataattacacagacagacagaaaaagaaacagtagctgtaagatttttcatttgccaatttcctaattgatttctggcctcagggtggagcccttcaagaagcatggctaggaaaaaaatgcagtttctacagtttagtaagaaggcacagctggaagacaaaaacagattttgagagagatctattcacttttaactcttggagttccgtgatgcttaatattgagtgtcaacttgattggattgaaggatgcaaaatactgatcctgggtgtgtctgtaagggtgttgccaaaggagattaacatttgagtcagtgcactgggagaggcagacccactctcaatctggttgggcaccatctaatcagatgccagcatggcaggaaggtagaagagcagacttgctgagtcttctggccttcatctttctcctgtgctggatgcttcttcctacccttgaacaccagactccaagttcttctgtttctagactctcagacttaacaccagtgatttgccaggggcttttgggccatcagccacagactgaaggctgtacttttggcttccctacttttgagattttgggacttggaatgacttctttgctcttcagcatgaagacagcctattgtggaactttaccttatgatcatgtgagtgaagacttcttaataaactcccttttatatatacatctattctattagtcctgtccctctagaggaccttgactaatgcagattttggtactagtagtggttctagaagaatagaattttaaggatggatttctttagtgggttgtaggttttctggagtttggtgtttaacatgattagattgaaaaatgctaagggctctagtatggagaacattaatagtccatggcatgaactatttagagaattatgcaaaataaatgcatttgacactcctgattcactgctaatgaaaggcaaggagtttagtgactctatacatattacttttgaccatatgtggagtaccaaggaatataatgaagttgtttagttgctcctaagtttgctggacaaagtgacaaaagaaaaaggatgagctcaagtattctaactcctggctccagaagcacatactgagcctcaagtcttctaagattgccaagcgagaatcttatttcctgtagacaaagggctgaaatcgcagaaaatcaggcacaagctcttctcatgcaagtggctgacctgcaaagaaaggtacacactcagtctcaccaagtgtctactgttaaagtaggggtattaattggaaaagaataggaggctgcaatttggaataaggaaactggagatactgagcttgtaaactcttatgagcctttttttgccagaagaaacaacctccccacctccagtggtaggaacatccactccccgacccacgctgccttcagcctttccacctttgtctgaggagattaaccatgtactacctgaggcaacagtgatggcttcccctgaggcagttgtcagtcaagacaatgctgattctcctcaggacctacccccaacaccccggtttgcttctagacctgtaacgaaatcccggcaggcccccagaggtgagattctgaatgtgacccatgaggaggtgcactacactccaaaagaactgcttgagttttctcatttatataagcagaaatctggagaacaggcatgggaatggatattaagggtgtgggataatggtggaaggaacataaagttggaccaggctgaatttattgatatgtgcccactaagaaggaatcctgcatttagtgttgcagctcggggagttaaaaaaggttcttgtcattcatttatttgcttagttagctgaaatatggatcaaaagatggcccactgtgagcgagctggaaatgcctgatcatttaatgaagaagaagggattcaaaggcttagggagattggaatgctggagtggattaatcactttagaccttacaactttagagcttacagttcctttggcccatgctgctcagcaggtcctagattcttgtctcacatccaagaagaatgaggtagcactgacaattgtagtgggaggagagtggagaagaattttattaagtgacagaacagttctcagtggagaggggatgtgagggtggttccccacccaaagttgggtggtttctcctccagtgtggcaaggcttggggcttttatgggctcagaatgggggagtgcatagtgactggtttgtgagtatgcagaaaggctaaaacaaagacgccagtcaaaggtgggcagggtagtgtaaaaaaccagttagagaaaagtaggtatatgtaaaacaggtgaagggtaaggattaatcagaagaaagggtgctgaacaggaagagaggttctcaatctggtccatggatttcacttgtagattggctttcagggttgaaaatggggtttcaccaggcatctgcacctaactgccagagtgcttactgctgctatcattggtcttgaattcttgagctcaagggatcttcctgcccctgcctcccaagtagttgagatcacaggcacacaccaccatgcctggcttaaggttaatttctaaataaatacatatatagatccaaatatagaatatgtgagcaaacctgggtgtgtgtataatattcctttaaaatggagggaggtaagtaagaaactacaaaagggaaatcaacaatcgatttttgactgttgaaggaattgaattcatagttgcaaacttcatcgcaaagaaaaccctagtggtagatggaatccaagggatatttcgccaaatatttaagaaaaaaataaacttattctactcaaactttccagtaaattgaggaggaggaaatattccttaattcatctttgaggccagaattatcatgtattgatagcttacttttttaacaaaaatataaaagcacatcagttaagaaaagatagtttttaatggatgtttctgaaactattgaatttctattggcaaaaataaaagcactttcatacatatctcacaccatagacaaaattcactcaaaatgtataatgcaccaaaagttaaaaactgaaattttaaaattctacataaaacacatgagaattctttgcaaacttggttagacaaatatttcttagatataacatcacaagcaggattcagaaataaacaaatttattcattaaacttaatcaaaatttaaaaatgttgtcctttgaaagatattattgagaaaaggaaaagaccagccacacatgtagataaaatatttgaaaaatatacacttaataaaggtattgaaaaacagaatctataagcagaaatacaataatagcagaagactgctgtatttcactttcatcaatggataaaacatccaaatagaaaattagtaaggaaacatcaaacttaaacaactctatagaccaaatggacctgactgacctatacagaacattccacccaacagcagcaagacaagcattcttctcaagaacatacagaacattattcatgataccttacatgttatgccacaaaacaagtctacatttaagaagactgaaatcatatcagttatgttttccagccacaatggtatgaaactataaatcaatagcaggaggaaaattggaaaactcaaaaatacatgaaaattaaacaaacaatcctaaactcccaatgagtcaaagaagaaatcaaaagggaactgaaaaagaaaattagagaaatgaaaatgaaaactaacataccaaaatttataaatgtagcaaaagcactcagaaggaagtttatagcaatacacacctacataaagagagatctttaataaataatctaaccttatgcctcaagtaactagaaaagtaaaaacaaactaatccgaaagttagctgaatgaaagaaacaaaaaagtagagaataaatcaaagaaatagactagaaaaacaatagatccaagaaactaagattctttttttaaaaaaaaagcataaacaaaatagataaaactttagctagtcaaagaaaatgagagaatactcaaataataaaataaatgaaagataataaattataactgatgctacagaaatagtattttcaattatatggtaacaaagtgcataacctagagaaatggataacttcctagaaaaatacaacttaccaaaactgacttatgaagatatagaaaatctcaacagacaaataataagttaggagattgaatcaaatagaatatctcccaacaatgaaaggaccagatggcttcactggtgaattctacaaaatattaaaaaagtaattaaggccaattattctcaaactttttcaaaaaatattgaactggagagaacatttccaaatttattttatgagaccagcaataccctgataccaatgcctgacaaagatgctctaagaaaagaaaatttaaagacaatatcctgctgaacatagatgtagaaaatttcaacaaaatatacaaccaaactgaatttaagagcacattagaaggaacttactccgtgatcaaatgggatttattcctggaatgcaaggatggttcaacatatgcaggataaaaagcatatgatcattttaatagacacagactaaaaattgacacaatttaacaccctttctcaataaaaatgctcaacaaactaggtttatagaaggaatgtatcacaacataataaaggccatatatcacaagcccagggctaacatcatacttcaatgtgataggtttgaagtcaggagaattggggaggaaatgatagatatacacattaccatgaatgtggtgatggtttatgagtatataaatttgtcaaaagatataaaatttgtcactttaaacatgtgcagtttgttgcacatagattccttctcaatatactgttttaaaaactttctatattcatccaaagttgttgtattatttatccaaaacaattttattaagaatattttgaaattcctatactgagctagtttactacaatgttagcagacagaataagaaaactgtattttacactgaattttagaaaagacaaatttaaagaaagtaaactcttttcagtgtaaaaccttaaccattactaagacaaagtcaggttcaatatagtactgcagaaagagaaagactttgtgtttcagattttcattttgatctgtagccagcagtgcttgttttaatatggtgattatctttctattataagatggtggttaaggggaataaaaaccaaaattctagaccatctggatacaaatctgaaccctatcactaaatctaaatatctctttcctcatctgtaaatggggcaataacaatacttacataatgttctgtgaagattgagttggcaaacaagtggagagtagaatgttagataccagaggctggtaagggtatgtgagtgggatgaagaaaggttggctaatggatacaaacagagttacacagaagaaaaaagtctaatattcaatagcagagtaggatgactatagttagcaacaatgtattgtatatttcaaagtaggtacaagagaaaagttaaaatggtcccaacatatagtgatgctaaatactcaaggtgatggataccccgtatagcttgactcgatcattacaaattctatgcacgtaacagacactcacatgtacaccataaatatgtaaaatattatgtatcaataaaataaactgagttgatacacataaaacactttgagtttctagcacaaagtagatattcaaaaaaagtcaaccaatattactaatatcagaaaactttattttctgattattctgtttaccaaaattttactggttatcaagagtttaatcaatattcatattctgctaatcatttcatagcctcttattttacttattttgaaaaacaagtacaaaccttcagaaaagtgattgaaaatattagaaattaatttactatagattttcaatgaattaaatataagatctaacattcaacattctttacattaaggcaaaaaaatcacttggggccaaacaacatactgtgagagacaaatgttacatacattgtcatgatgcaactaacatatgggagatgctttaaaatgaaaatacagtaactataatttaataaaaatatttttgatttattttttctaattacagtaaatgcaatatttacttctattgctttggtattttatatgtggtacctttgattttttaataataattaaacactaacaataaaacaataatggtaattgctaatgcttatacagcagttactagttaatagacacaaatttacatcctttacatatatttactaatataatctttgtaatattcctaaaatttaagtatattattgttcccatgatgataataaaaatgaggtaattgagatacaggtaacttgaataatttgtccaagatcacacacctagaaaaggcacaggattaggacttgacaaaacactctcacacaaatctacctaccgccatttctttatttactttaccatgcaaaatagaatatattccaccacagtctatttatctacacctcgatttctctagtcatctgtatatctcaatgtcttctgtgacactcatttattatttcaaatctttaaaattcagtaactttcaacaatattcttgctagtatgtgaacatatctgtattcatccatgctctccctctctagtgctttgtaacacttggtcatagtgatgaatatgtgcagtagctacagacataaacattagcattgctttggcaatgatggcattagaatatggcacaacctacctgctttcattgtgtcttatgatgttgacagacattgacatagatcacagttaagtttgaattattataatttttttctttttttgagaaggagtgtcactttgccttccaggctggagcacagtggggcaatctcggctcactgcaacctccacctgctgggttcaagcaattctacctcagcctcctgagtagctgggattacaggtgtgtgccaccacactcagctaatttttgtatttttagtagagatggagtttcaccatattggctggtctcgaactcttgacctaaggtgatgcaactgatcacctgaggcctcagcctcccaaagtggtgggactacaggtgtgagccactgtgcaaatttttaaatgaataaaatattgtcactgggtttgtacctaggttgaagattacatatatttagagcaaatgctttgcaattccaactgcacaatatgtatttcatttcccattacctatatcaccaacatttagttgttattccgaagtaaaaataattgtttttcatgctgtggatttcttacatgtcccctttctttgttaaagctcaaattgaagaaagttcatttgagttctacatgaccaggcaggaaggatatggaaaaacatgcctatgggataggaatattattattacatgaagtatatataaattacttgataatgcatatttgaataaatgataatacctttaaaaagtaaagggaagtgaaaattaccttcagctctttgccctgcttctgcttgtagtagtttttttttaatgcaacttttacacctactgtacaaatataattaaaataaaagttgatttaacatatttctaagcctgatttatttataaaccaattgtaatgaagattcacaagcaaaataactttagtcctgtggcttccaaactgccatcctggtgtgcagcaatgtattcaaaaggcacaatgggatacttttaattttctagggaaacacaacagtacctttggatatccacgacttctactattaactttttgtacttaactacttaataaaaagaactgctggaaatttattttggcttaggaataattttgaaaaattacgtgcaccataaaccaaggaattatgggaacctctgttttagatacttccttatattactatattggaatttttgttataatggatactacagggctaatttatatgtgtcaattgctaaaccagaatctggcacatgtacagtgagaattcatctgaaggtaacaacaattgcaacatgctgtaccaatcctcatgccctatttcccaagcaggtctgtatcattagagaaaaggaaattaattggttctctctacagactctctgtttatgttctgtcaacaaagtgtagagatcagaaaccaccttttaatatttttctcttgcatggtaattattaaaaatccaccccccaatagcttccattattctgctaggctactctttccttttctcatatttgtttgttttcccattatttttctactatgcatttatccagaagtttcagtgtgaattaatagcttttctttcaaagaaaaaatatttcttacaggatatatttccatattcagcactagagaaataaacccaacaaattctgtgacagaacatgcaagccagaataatacactctgtcaatgaaattaaaaaatcatcataatatcagatccacctctaattataaagacttcttctcagggcctaatgtttcttagagacctatcatctcctcttgtactttcaataaatctcagatgtgtcttaagctgtatataattatatgacttcaaattgtgtatttgaaagaaattccagttgagtgaagactcttaacgcctaatgatgtaggagcaaagcgccaagagggtcccctattgtaagtaccttgacaaccccatgttttagtgctaaaattcagctttttggaagtagctactttgcagttccatggaatgaaactcaatttgtatcactggctgctgtgctgtaaaggagaatttcaatgccctattgagtactaagtctttttgttagtttatttgcatgtttgcagaataatctttacactgacataatgacacagtcataaaatttcctgaattgaacttttgcttccctctggaaatgatgagattggaagaaaaaaaattggtataaaacaaatgaatacaaaatagaggtttctctgcaattaaggatacacggggctcattattgtaatgtaggaagggtatacccaagaaaagatttaaacgtccctcagtaaaactgtggaagaaaattttgctggttggtgagaatataaataacaaaagagaaccgagagtgaacagttctaggaaggataaacacttcctgaatgttaagctaatttttaaaaattatgatctggttattttaaaaatgttaatctattatattagaccattttgtgtggctagaaaggaatacttgagactgagtaatttgtaaagaaaagagatttatttagctcacagttctgcaggttgtacaagaagtatggcaccagcatctgctcctggtcagtactgcaggaagctttcactcatgctagaaaatgaaagagagcagccatgtcacatggcaagagagggagcaagagcaaaggaagcaagagagatgccagcctcttttaaaccagcagctctcccattaactaagagtgtgaagactcactcattgccatggggagggcaccaagtcattcaccagagatctttctccatgacccaagcacctcccaccaggcctcacctccaacactggggatcagatttcaacatgagatttggatgggacaaacatccaaattatatcatctattaaaatgaattttaattacagaatactcaaaaggaacatatttcaataaaaatctactccaagagatctacttttaaaaatggttaaagtaaataaataaatgcaggcattttatggatttttaatacagagatcttatttcatgatcctcattgcatgtttccttttataaacgtaaaatactacattcactctattaaatgctttctaattcaattctatttagtctaaaaatatgtttacatctgctttctttattattttgtttattggctatcttacaactcgagttctatttttttactgatagattttctaaaccacattttagaatttgtatcttctaattggggaacttagcccatttaaactcacagtcatacttgatattgtatacttcattgctagtatttgctattgtctagttctctaatggcttatatatttatttacttttctctattgtggttatttgttcttcttgaatcctgttcattctttttgattgtttcagtttaataaaaattttactgaagtctaaattgtctacaagtgccaagaaataaaaaagctaattatttttatttttctatttttggaggaagaaaaaattcaattttagttcaaaaataaccttcagtctttccaaccccactctttgaaatgtaaaatgtgtatacccactctaaataaaatgtgtttaaaattatacatttattttttatttatatatttatttttgagacaggatcttgttttgttgctcacgctggagtgtgatggcatgatcttggctcactgcagcatcaactttccaagctcaagcaatcctctcatctcagcttcccaagtagctgggattataggcatgcaccaccatgcccaactaattttgcttatttttagtagagaaaaggtctcgctatgttgcccagactggtctcaaattcctgggcccaaatgatcctcctgcctttgcctcccaaagtgttaggattacaggcatgagccacagcactcagccaatagtacacaatttaaacctacacttacattccgaaaattattttttacttctgtattttatttttaaatcataatcttaacaggcattatagtttacttctttactactgtgaaatttcctacttgagttctggattttgattaatttcttaaagagtagttttcatcccagtggaaaatcctgtctcattgataatatgtccctgcagaaactgacatttcccagagagctaactctacctttaactcttttccactccagaaagcacaacggaggtgtaaactattttcatcttttcagaattataggctactatcttgttattttttaccttgcagttatatgtacactgctatttctaattatgggtacttttcattaattttacctaaaacttggtgaacaattctgatttattgcatcactgttctctacttccacctttctctgtccccctgcctccctctcttttcccttttttctcatctctttctccccttatttctttcttctctgtctcttctaccttcttcatcccttcgtctcttgatttacctatatgttttcttcatattctgaatttttgaaatttcttctttataccaaaccaaaaaacatttattcttttttcctagttgataacagttctctactatccttatacggatatttgttatttttctccttcactttcttccttatttctgtcatctctgtgttcatatttgcctctatgtcacccttttgtctctctgctattattttctaggaccattcccattgtattattttcttaagaaattaggctgatgttaatgttttatatattggaagacgcttgcaaaggttgtgctcttctgactctagccagccctggaattttgctacatatggaaggtagctgaaagcccataatattgctctctgtatcagtgatgctagctacttttgccttcttagggaaaaacaaaacaaaacaaaaacaactccaaggcatttctatgagactatgaattactgttgcagtctgcttagttcctagttcagctaggtctgagttcttgtcccctgaccaaaatgaataaggcatacggacactgaacagtgagtagagtaggatttattaggcaaaaggagagctctcagcaaagagagaggacgagaaagcaggttgccagaaatggggctgagttctagttctttcacgtggcaagagcaaggaagtcttccgtgggttctgcccaaaacggaagaaggatgttgcacctgcacatgcttggggttggccagagtaactctatcttgcttattgcccatgagtgctttggcaaacccatggtggggaggcagggaggcagggagttgggggactacaaaccacaatactaatgtcatattaatgacattataattagttgcatcaagttaaggacatttaggttgatttattgtgcctgggcctaagttgggacagtcctctctgagcaacaacctgccacaagggaaaattcttaagcacatttcttcctgtgagctgcagaggcagtgtaggtgctctcctgcaggtgttcctgtgaacatttaccttctcctgagaccttccttctctatctgcctaaccagcctctaactgcctcctctctcattactttaaatctgacactttacagacttctatgtagcacaaatgttccatgggaatattttgcattctcctgttcagtcaggttatctgacttaaataagatttctttttaaaaaaaataggttagatactagtgttaaaagccacagttcacccaaatatacctttcccccactgtgtttcctgtctgctctcttccttgcttgaagtttagggattgggaataaaatacaaatatttcattctatgtttcttacccacaatctagactgcacgtacagaacgttatgtttgagtcatagataccaatttttcttgttgacaaagtgtttttttttctcagaaataagtttagaaaatgagagttactaaatgctatttcttcattatttgaaaagcagaaaagctaagaatataaatagataatctagaaatgtgctcctcactccttcctataaattaaaaagaagtataatctagaggcttgctgaaatcttttgcaagatactgtggtgtagtaaagaccacaaaatttagaatcaaagaggtcagggtactagactctattctgaatatatgacttttgttcaatgaacaccctgatgacattcgatttaccctttgtctctctcatagaattgttgtgaattcaatgccaagtactcatttccttcaagtcacacataataacttaaggattttttagtaatgttttacttttgcttaaaaggtattaaaatcaaagagttgtatctttgtgtctcctaattaatagccaaacttttctacaagtgagtataaaagtcactgtgatgatataaattgtagaggagaatagtttcagattagaggaataatcatttctcatgacttcagagaaagacaaggcaaaaataaaatcctagaaggaaaagccacagacacagggggtgggggggccctatgggcagtgagagagccagatttgtgtggctcttaaaggtgtttctctgaggattattgatgacaacaactatctattacatattgatttctggtatgtcattgccttgagtcttgcagacatgaaagaaaatagcttacattataattgtcatgatgacaaacataaataaaacaggttctgaacagctttcaggggaaaaattacatttttacatggtgatcatgagtgtgcattttttttctataacttcagctctcactcatagtcaaggaaggatataaacaaattcaatatagtactttatgttaacaggggtcaatgaggctgcctctcatccggcaattttgtcagtatcctatctgagaaacactgatctgttttcaaaatgctaattccacagtccagcacttgggcaagaaatccaacataacatgatccaagaaaaatatctggagagtataggtaccactcatcaattcttggtatccttctgttgttcactaaaaagattttgtcacaaatatgcattctctaggaaatcccttaataaaatatacaaaaatttagttacatagtcaccaagctgacattaatactaacaatgttaatattaaacatattaaatgaagccaatcattcaactccataaacaaattgtgaatctacatcattttattggtggataagaatggttcagaaaatgataaggtggtctccaacaatggatggataagtttgtttttctgatgtgttttttatttttattattatagaaaaagaggaataaatttttaatttctcatgttgcttctcaaagtctgacttaaagcataagctattgaggtgacacaatccctttcctttcatgagacacacaattaaatgagtaaataagaggaggtgatctgtattctatccctgccatattgacttttacttggcaagaatgttatgggataaaactcaagaaaatctataactgcattcccttacttattctcattttgtatttggagaagatgcggggcagatatgtgtgattataatgaaaatgacacaaattttaggaatactatccagtggaatgagggaactggttataaagcaggctgttccgtgattaagttttgccttattcttagtagttcctttaagggttattaaaatattaggttagtggtagggcttagcctcactattacccctagttggagtttgctaggttgaagttcagatattaactgagaaataactgggtatgggcacattaagtatttgatatagagtgtgcccctaggaaatgagggagtttcttacggttgtgattgtggttggtttaaatttgttattgctaagaaatctttgtaagttccagatctgctttttctagatgagtgaaatcgtacatgtcagtaaatccaattttcactttcctcttgggtaaaataatattaatatcactgtattatccaagaatcttaatgcaaattttattttaattgtaaaatctatgaaaacaaatacatttacttttagctttgttatatattagttaactatatttaaggttgtaattctgaagtctaacatcagctcactgactcattcattcattcactcactcattcattagagtttggagcacctgtcctatactggtaggtgaattgatcacatagatcatacagtcctaatgaaagaagcagttactaaagagtgaataaactcataattaaataatgtcaaacaatcttaacttatgtgaaagtaaaataggatgatgtaatattgaaatagcaggatacattacccggagaagaagatatttgagctgcaaaacaaatgtccagatggagaaagccatgcaaacatgagataaatattttcccaaacagaaggatcagtaaatacacaggcccaaataaaattatgtctcgtcattcacagagatggaaagaaggtggaaggattgtagtcagcccggagaatagctgatggggatggattatgaagaagcagggatctggtcacgtggccccttgaatattttgctatggggtttggatttttttctacatggcatgtgaagctcttagggaatacaatgaggggtgggagatatttgctaatttataattttcaaaggcgactatcattttacgatggataatgtgtaatgtggagaatagagaatgaatgtaaaggaacccagagtagaagctgagagattcaattaattttattcacatagacagaataagaaaatacttagacctagtagtgaagtagttagtgaagatgttagaaaaaaaagaggccaagtacctacattggcaaggtaatgttgatccctgcattattttaagatagataacaaaaaaatatagcatagtattaggaagataattttttccatttaagtctagatatatcatttttaaaccaaaattataaagatttataatatctattaataattagttatttgagtctaattttcttaaaaaaaaaaaaatatatatatatatatatatatatatatacattctgatatttgaggctttctgaccagaggaacttttacttttctaatagaacagctcttgcccctatcacccatcctcattcaagtatgggttctattctagtagaagtcagaatcgatggcttctaatgctaatccttgatagtcagccatagcgtggccctccagacaagtgatagaatgactatgaaagttggaggataccttagaaatcacatttttagattatttaacagattgaagaagctaacatgaccagaccaagatcacatgataattgctctccaaagaaatagttttcgtctatgtcatctgttttccagatcaaagtatgtactaaaaactgaggttcacattcaccagggttcagacactgctctcatcagcatagcgaccttaccactgtgattttctgctttcacttaaatgaaagtaagtataacttactgtcttgccagctgtgtttgtttggtccttcccctgcccctcccaagaagagtgaggcaaagatttgatttcacgtagtttatttggatcccaggaaaacagcaggaaagtgagtcaaggcacagaaggaactctataaaaggtgatgtgctttgccctggtgagcgagctttcactgtgggccacggagattccatctccctggtgaagtctgggaaacactgaagagcacgcctctgagttgccttgccttcccttggggcgaggaagctgaggcattgatctctaattattagccatcagctgtcattggctgagggctgctccttggaaagggcctgcctcctgggaagaggaagcaaagggcgaaagtcgcatattatgctataatacagcaaagcatggctggaatggtgagagcctaggggatatgggtggggcatcaacaattagctattgcagctaaaaatatttaaaatatttaaaaatattagttattaaatatatttaaaatactttttaaaactttatcatttttcattgttttcatcaggaatctcaatcagggattttaatttcctctagtgccagaaatagaaatgtaaacaattatattctgtagtttcatacacaaacttaaataaaaagtaaagttttgtatacttaaataccaaagtaaatgataatacatggcatgtttgattcgtttggagttaacaacacaaaaactctataactagagaagtagtgcgtgttcttaaaataaagtcagagctgacattcatttgttacatttgttttacataaaaacctccctcttgactcaggtccagagttatcactaggaaaacccaggcactttttcagcacctggctctttttccgttgtcatctgtatgatcttcatatttatttcctcccctttatattcctatgaaggatctagcaccatcactgtctatctcatgctcccctttcttaaaaactctactttctaaagggtattaaaacctatttatattatgttttgtgtacataacaaccccgggcaaatgattagtaattagaaagtggtggttaatcgacaaatatctaaaatggtatgtttcttagagttatctacagtaactaatacaaaatttctgaaaccaaacaagttgaaacaagaactggcgtgtcctcattttcctgttccacttttcctctactgctttatgatttttgggcttcactggatttgattctagaggctttcataacgttttcatggtcactatgtcacatattgttggtagaattttctgtaaattccctcttatgtaaacattttatctaattttaaaaattttttttctaattgcctttcccccagaagcaaatttgtatttttaattaaacagagaattcttagagaaataaagagaaattaaaaagctagtagaaggaagacatttctttaataaatctcatagtttctgctttgaaactaagtgccatattgaattaaatgggtatttttgcacacacatacataaagatatacacacacctattttaaacttaagaaaggattatatattataaatgacagatacctatatgacatagtgtttggctatacagagttcacacttgggctttagttacattcattttctgaatagtcatgttctatatccaaaaaactcgaagcaaatattacaaaccatcaaggccataagcattttattctttgcctacatgccttcatgacttctgactatgctaataaaagacatgaagtttcaataagtatttaagtacttatgagcacaaaagttgaaaaaacagagaattaaaacacagttctttaaatcccctcagcaatgtatgaaaaaattgactttcatttacatttgatatgtaatatcaaatattccataaatgcagatatatagatacagatagatgatagatgatataatattaatagatgcagagatagttgaaacacgatctgaaacaggatccacaatctacgatctgtagaccaagttcagtcaccacatttttctgtaaatctagctttatagaaacacaatcatgcccatgtgttgtgtttcgttaatggctgctttcacagagtgacagagatgacaaggtttgcaaagcctaaaatagttactatatgactcttcagaaaactttcagaaaacctttttgaacacttgttctggagcaaatcgtttttgcaatgacataagaagcttgcactaaaacaatgaccatttatctgctcattatctgtggtccaggactgaaagcaagctactctcactggttgttctagtccacatgggcttggcttagattatctactggagtacatttagctggatttggaagatccaagaaacaacttcactcatgcagttggtgcttcactgcttctctacaaagtctccttttacctttcccttcccttgcctcctctcctctttctcactgcccccagcctacattggcctcaagtttcacagtgtggtagtctagggcattcagactttttaaatgccagctgcttcagtaaagggccttttcaaaacgagaagttgaaagtttcagatttttttcctggacttagttgtcacacaaaatagattctactactttcttttcttttctttttttttttttttttttgatttttgagatggagtttcactcttgttgcccaggctggagtacaatggcgcgatctcgactcaccacaacctctgcctcccaggttcaagcgattctcctgcctcagcctcccgagtagctgggattacaggcatgcgccacaatgcccagataactttttgtatttttagtagagacagggtttctccatgttggtcaggctggtctcgaactgggtctaaacagaccataaggccagtgcagatacaaggggaggggaaaaaaagactaccttttcatagggaagtggcaaagtcacattaggaagcaccacttgtgatgagaagtatttttgcctcaatctttagaatcacattctaccagaaggatgtttaatgacaaatgaatttatattctggcagagttcttcatcttatcacagaatgttaactaaaagtgtgtagaaagctagccagtccgaggaacacattgagaagttctgaccttgatcctagaacactacaaagaattcaaaattttttgatgatcttaatgagataatttaacatactcattttatgttggattttgtatgtatatgtagaaaacattttaggaaagatgtattagtaaatttctagtaaatgtatactcaaaattgcatttctgaaatatatctttcccaaatgaaatattattgaaaacttgtctttgtttaaacaaattcttaatacttaaaaggctggatatggatttgtgaaagcaaccctcattcttcttataaaagtattcttatctttccatttaatttgagcttatgcttactagatgttattaaactcgactgaaatagacaatttttatacaaagatgtcttaggtgtagtcataatgaccaaaactatagatcataatctttcatgtaatttcaaatgatttcactcatgtgtttggtgtctcaacaccaaaacgataagctatgaaagaaagtgggctgtcaatatttgacaaataatattccataaagtgaaagatttttacttataataacctgaaaaaatgaaaaaaatccatttggttcttaaagtgatcaattgtatattttctatatttctatgccacatgggatgttaggaatttttaattatactgtggattgctttgagattttttttaataagttgattcatgaataaatttaaaagaataaaaagtttcaaaaacctataattaaaattattcttttggtaaacatggaataagttattaaaataaaataatattacataaagaataatttgaaatttacataatatgtgatatacatatataactttccaaatggtctgatgtgtctgatttcattatataatttcagatgaagattatagattcattatgagagtaaaaactataaaagatttttgttcagaaaaagactaagaaaactgcctcaggaataatttgtacaatcatgtatttcaggggctctccattaagtaacaatttagcaatgctttctcaaaatggtgattgaccaaagccatcataggatacagagggaaaaatgtgtcctacgaaaagtgctttttgaaaacatgttttagaggtctatacccttgaataagatttttagtgtgaaggccgggcgcggtagctcacacctgtaatcccagcactttgggaggccaaggcgggtggatcacgaggtcaggagatcgagaccatcttggctaacacggtgaaaccccgtctctactaaaaatgcaaaaaattagccgggagtggttgcgggcgcctgtagtcccagctactcgggaggctgaggcaggagaatggcgtgaacccgggaggcggagcttgcagtgagccgagatcgcagcactgcactctagtctgggcgacagagcaagactccgtctcagaaaaaaaaaaaaaaaaaaaaaaaaaaaaaagattttaatgcaaaatacagtaacctcttatttatcgtatatttgcatacctgtgaatgtagacctagtgatggtgttttgtactctggaagaagcatgtggctgccacatctttatatttgctttagtatttgccctctggctatattaatggacatcgctatccaagatgctcccacacacatgccattattgactaagtgggtttaaatatacttgtaaatgccataaagggttgactttgtcttctgcaaaaataaatgagtaaaagggttcctcaaatttatttttttactaatcatctcccatgggcttaatagaaaaacaataagctctgaaagaaagtgggcaagtaaactgcaaaataaaaaaaaaaaaacaacttggaaaagcataatatgttcaaaaaattcaaattgtgtaatatatgggaacatgtcactttctgcagcagaaagtttgaaagttgtgatatccatgcaaatcctagcataaatgctaagatgagatgtaagataatcagaaatttaactagaacgttttttaagagcctctcaagcatttgtggtctgttaatgagattccagtgtttatttatagcagttttgtgtccccagagctcaaaaagaatgtttggtaagagagaatgagaaggtgaaacatatatccacacaccaacctggccaagtctaagcagcactcctgtcagtattaaatgtaataggggtaacacaaaaattcatgtgtaggtatgattacatttagagggcactactgttgccaatatgatgtgatacctggcatgaaggctcaccaaagaggtcaatgtcctgtgaaaatgttattttacatgacaaaaaagggattaaggttgcagaagggattaagcttgctaatcacctgactttctgagatgaaaattattctcataatgatttgatgctgggcccaacgtgatcattttttaaaaagtggaagacagagaagaaagtgtttgagtcagagcagcatgatgtgagaaaatatggctcgctgttgctggctttgaagatggaagggagtcacaagccaaggaatcatggaagcctctagaatcaggaaaaggaagggttcgaactttccctgagagcccccaggaagggatgcagcccggttgacaccttgattttagccccgtgaaacccattcagcgcttctgatctccctaagtgtgatataataaagtagtgtgtgctaagcccctaagtttgtggtcatgttacatcagtgacagaaatctaataaataggttttgacttctccagatagactaagcgcaggctgcatccttcctgctcaggctgtgaatgacccaacaaaaacttaacaggagatcttctccccttacgtattccccctacttctttaaaaattgttttgccctcatttctgccatgacttaccctctactgacttccccacaaacatatgaaaagtctgttcgaatggctttctttgtactgtggctactggacagttatcatctttgaatgtttacagtgttgactaagaaaaaatctaaagagcaaatgaagaaggaataacaggtatgaaagtaaactgctacgatgagtctgtcaggattttacttctaattacaacaataaaaattgaaagactatgttcattctgaagaaaaaataagttttttcaccactactaccagaacccagctgattctggaagctatagaagtgtggaaaaagaaatacagaggaaatatttttctttccacttgagagaatgtacagaaatacagcacacacacacactgaattgaacagaaatattctggtgcctacaagcttcctgcaggttaattcccgctgtggtgggaactggcctgatttgcactgacatgcaatgctcgtcatagacaaatgcctcctatagagaagtgccttcaggttgctccggtttgggacagaacattccattgcacttacatggttacatcttatttattgttagacacatttttagacagaaaacattctccatttctatcattataacttttgttgagattccaaaataaattatccatgctatcatactcagtcacagtgaaacaataaatatggtagcatattaaaaaaaaatggaatacatgatgaatgacaataaaggacgagagcactattctcattaaattcagagagccagctctgggacgtgtcagatgtgatatttgatgacaataactgcaattaatcttgcataagaatttgcctaatcctgtaatgtagaagctttatttttttttaatcatctaatagcttatcctgaagtgaaaagaaagcatttgtcaactaggtcaaggggagtaagaaaattggaaattttaaaaaacatagacaaagaacgtacacagaataaagccagtaactttcagcacatcatgacccatttgaagacaactattaaataagtttaatttcatttaacttttaactgatgtcagcctaataatatattgatgttaaagtaacaggtaacttgctgttcttacatacacacatggatacacatagaagcacatatatgcaatttttcaatattctataagaactgttatttatgtagttatcagctgatgttaaattataaatggagaatggtgttaacatatgtcataatttaagactatttctaagagcagcattattggctaacccattttaaaaataatgtatcagaggctttcacatatgatttaagactcacaaatgtattttagatttgcaactttatcagcaaagcagcaccttttaaataaataattaaaaattcctcatttgaaacattcattattaatgagacactttgattaatattaagagtaggcatttaatttgtgaagtacaccatatatacacaacagtgcactagtcataagtatacaacttgatgagttttcacagtttacatacagacataacactacatagatataatggactaggcaatgttttatatcatgcttttaaagcaacaataaagttttgattttccaaagaggaaagaagataaaatgtataatatgttaaataaaatatcattgcaaccttatataaattagagaaaaaagaagaagaaacgatgttcttttgaaaacagtgatctgaaattaaagcagagagccagccaaagaaaccagtacagatatgatctgagcaaggtctcacccacaaatcttatttattttgttgacagttgttagactagacaccagagaaccgtggatgaggaatgtagtggatctactatgttgaatatgaaggagtcaacatgtatttatgaaatgtgatatttgtactaaattagtcgagaaagaggactcaagaacgggttctacatgaatggaattatttgtgttagagatcagattttaaggttggcttgcctgatgttgtttagaaggcagaattctaatattgtgagaattatttttgttctttctagagtatctgaaaattaaatatcaaggaaaaagagagcttacgtttagaaattggaaggaaatctgtgaatcacaataatactttttgattttaaacagcttcacatgaattaacatcaagtgaatttgaaaagcagccaaataaaacccaggaatattatcttgttttttatttttcttttcttctaaaaataatgattggatacaagtataaattcagacttctcaaaacttagctctcaaatcatgatccccaaacagtaacacactcaagccaagaattttgaattgtttttatttctctcgaaaagatggattctctcagaatattcttagtccattctcttacagtacagtgactaatgtattaccacaggagcttgtttaccatccagtttccttgactctacattcagagactctgacttgataaacctgtgttggaacgtggaattctgaatttgtaacatataccccccaggtaattctatggagagtaattcaattaatagtaactagtatcaataattcagaaatacaagtacttcaatttttggcattgatgatagatattgtttcacagcatttaatgatttggccaaaagttttaattgcattgctactctacaatatatgtaaatatgtagcccaagtgtatgctatttgaagctgcattaattcttccaacatactatagtgcttttaaattaatttttaatttagctaatgctctgtatctctgctctaaagagtcaaacatcgagaaaatctgaagttactgaattatcaacaaatactataaacaaattgagtttcctcatagacagatgaggcattaataaatgttaacattaatttactcatggcctattttgtgcaagttatggttctagggagaataatgattaaaaatgtatgttctactgttgggatgcactcaggatggtggcagaaatattaagggaaatattaggaaaattatagaaaatagtcacaaatcttttggaaggctgaaaggttacatagcttgtaataattgaacaggctgaaggcagccggttcttacctcagagcattaggtcataaggtaaatattagggacaatagaggcttccccagttaagtctgtttcccctacttccattaactaacctttgagccagatggccctcttggagggaggtcaactagggatattgcccccaatggtatttactttagaccttggtacctgaactttaatcattcgtagaactactctcttaaccatgttaattatccataagtgtgtttactcaaaacttctgttgttgattgtacactaaataaatgcctggagtgtgagctgctcagggccggccatagtgacaaacctctcttggtgtgcaggcagttggacactcagctggactggcaaaacagaatatctgtgtgtcagtctatgctttattcatacgtcgtttgggtcagggtctgagggcagacccccgcagctaatgcccacgtgtgaggagccttacctcattctacaatcctctacaatcctatgaagagggtagtgtaatgttaagtgtagagtacatgtgtgcgtctatgcctgtgactgtattactctagtaaggccacaaagtgcatctcttgaagagacgatattgaattataacaaagtgacctgaagtttgcattcagtgaaataatcagaagtataatgttatataacattatacttataagctctttgccaggaaacaggaagatgaaagaaataatctgtattgggtatcaactctggatcaagaagtcttttatctgcttctcacatattatcttgttacacattaccacccaacatcacaatttgtactggataaatattctgaaagaatgtgacttaagtgagtcccaaagcccccaaatcagaagaccacttttcaaggcaactaggatagacacatcaaggtgcagaaacaccaagtccttctctctgtcttaaggtacttatatttttcatgaggggagaccaataataagcaataaaaataggttgaccaggtgcagtagctcatgcctgtcatcccagcacttagggaggctgaggcgggcggatcacctgaggtcgagagtgcaagaccagcctgaccaacatggagaaaccccatctctattaaaaatacaaaatcagccaggcataatggtgcatgcctgtaatcctagctactagggaggctgaggcaggagaatcgcttgaacctgggaggcggaggttgtggtgagccgagattgtgccattgcactctggcccgggcaacaagagtaaaactgtgtctcaaaaattaaaaaataggtggagactgtatcatgttaagaggtgatacatgcaatgaaaaaataaataaagagaaaaataaaggggaaattagaggctgggggccactggaagggagacaccttgccatattaaacaaagaggccagggcagacctttttcagaaagtgactggagcaaagacttaaaagaggtagaaacagcccatcatatgtttaggaggagaacttttcagtaagaagaagaaaaagctggaaaagaagcaccagtatcaaatgtgacaagtatgttgaaggaacatccaggaagtcaaggtgagagcaggtcagagggtggaatcaggccatgatggttgagcagaccatcacctgcattctgctttcactctgggcaaggggctaatggtgaaagtgtgggagcacagaagagctgtgatctgggctattatgtataagaatccctctgatcatgctgggcacagacaataagagtcaagtgcagaagcacggagatctgttaatcatctactttgcctacctttcagattcttttgctcgtttcttttcttcctcctgatttcttaatattgaagtctccaggctcagactttgctcttctcttctcctggtgcactcacactcttggtaacttcatcctgtttcatagaataaaccatcatctgattgttctcaaattcttatttctattgagatctctcttccacattctaatcacatatgaacgatttctagatttcctcctagaagcctccacttggattcttaataagaggtccaaaagtgactttctcatctttctcttaaaacttgttttattggctgccttttatgtttttggccccgtttcctgttgccaggccatgaggggtaatctaacagtctggattttttgtggtggttgacagaaacaggaaaacattatacctagagaattgaaggagagtggccatccatgagtgttgggatgtggggatgctggcattctgtgactcccttttcctcctgattatgcagtaaaaggccaggtaggggtttcatggctttgcatgctcctttttaaacttcttcacctccacctggagaagcaggaaacttttcagctgtttattcctcaggatgccaagtccaggaatgcagcatctcttttgttcttaagagagcagccagaaaacttgacacttatttcattctttagttggttgctttattaatcatacatgtggctggtgtggtggtacatggttctgcattgtttctacactacttctaggtagggtctaagtcagagggagaatgacatgcttttctgcccaccatactctctgacaagtgtatgttgcatgatagaatggtctcaccgtaaccaggaaagcaagattattattcctgtcccctaacagtagtgtaatggtggaaaatctgttacaaaatttctacagcatgtactttaactactctgttgaaatgtatttggaagtggtacaatcctttttgttttgtaatggaactgtaatggtcctaatcagttgattcaggcttgacctccataaagacaaacagtttcttctaatggtcctaatcagttgattcaggcttgacctccataaagacaaacagtttcttctaatcttagtcagacataggcagatgaatggaactggaactctgctctcaccatatacagaaaccaactcaagatagattaaagacttaaatttaagactaaaactataaaaacactagaagaaaatctagaaaaaactcttctaaccattggtgtagacaaagaatttatgactaagacctcaaaagaacaggcacaaaaaaacaccaaaaatagacaaatgggatttaattaaactaaaaagctcaccacagcaaaatatataatcaactgtgaacagacaacctgtggaatggaagaaaatatttacaaactatatatctgacagggaactaattcccagaatttacaagaaactcaaacaactcaacaaaaacctccaaataatctcattaaaaggcaggctaaggacattaatagacatttttcaaatgaccaacaagtatattaaaaaatgttcaatatcacacatcatcagaaaaattcaaatgaaaatcacaaaagacatcaccttataccagtaagaatggctattaataagagacaaaaaataacagatactggagaggatgcagagaaaagaaaactgttatatacggtttgtgggaatgtaaattagtacaaactctataaaaaaatgggatttctcaaagaaatagaaatagaaccatcatatgatccaccaatgccactactgagtatatctccaaaggaaaataaattattgtagcaaaaagatacctgtgcttgtatgtttaacacagcactatgcacaacagcaaatatattgaatcaataacataagtgcccatcaacgtgaaactggataaacaatatgtgatgcatatatatacaatgaaatagtattattcagccataaaaaggagtaaaactgtgtcttttgcagcaacatgggtagaactgaggccattaccttaggtgaaacaactcagacacacacaaaaaacactgcatgtactcacatgtatacatgggagctaaataatgtgtacacatagaagcagtgtgtggaatgatggacaatggagactcagagtgcgggagcttggcagggtgatggatgatggaaggctgcttggtgggtacaatgtgcattgctcagtgatgaatgcactgaaggccctgagtttaccgcaatgtaatttgtaattgtagcacaattgcatttgtatcccaaatataaacgaagacaacacacacacacacacacacacacacacacacacacacccacacaaatctaggcagagagactggggaaatagaagatccacatgaccccaggaagacttggatttgactttctatactccttgtcactcattgcatgaccttgagcaaggcattttgcctctgattctcagctatgtgtctacacctggtaaaatgatgcctgacctttacaattttttccacaagagaatttcaaataggagtgtacaggacattgctttttgataagaattgtgaatataagcattgtccttctccctcctcactccaaacctgatttgttacctaactttaggtgtttcaggcaccacgaatgaggttggactgaccatcaagagcaaatggagatgcttagccaatgaaaaccaaatttgaagacgcagccatggtgaggacagctttactgtccacttggttgactttcctgtcaaccaggtcttccttgttgtaagaccaacaaccaatcaggacaacaggtccttcctgttgtaagataaacaactaatcagaacaacaggtctttcctgttgtaagaacaaacaatcaggacaacaggtctttcctgctgtaagataaacaaccaatcaggacaacaggtctttcctgctgtaagataaacaaccaatcaggacaacaggtctttcctgttgttagaccaacaaccaatcaggacaacaggtctttcctgttgtaagaccgataaccaatcagggaaaagacaatggagtaaaatgtcagtgcagactcactgcagtgttgtgtttggcttattcatacaggcaatagtcattgctcacagaagacttacagccctccaaccaatcccattgccctgaaccccaaatttatacagccaaggtaaataccttccttaaactcaccttgaattaagctatatagtcactttattttcaagccagatttaacccatatagtgactgtccctctacaaaattgttgtagcattttgtaaaaaagatttttttttgctttctgcttatcttctaatatcttatcattgaaatggagagctgaggagtcttgcagaattatagcatttgagattttgagggtgcaagtccataagattttatggttcttggcatttttatatgtacttccaaaacagagtgaaaacaattatgtccaagctgtgctatcaacatagatgccaatcttgaatataaattaaggagataatgttactgcatgggtgaaaatctctgagaagatctcaatcatatcatgaatccccagtgactgtcacatatgtgaactcctagtagatgttacatatattttgtcatttttcttttgagcaagttatttgtatcatgattttacaaacccaaaaaacaggatgaggctaatatagcaaacaggcaacccattctattttacttcaatccctgaatgccagtaaagtttacttctcctttgacagctagaaaattgcaatttggaacggaaagcttatccctgcaataaagattggctagcaaagttttacaaagaaatgagaaatttggctgctggttgtatttgaaccttgttggaaaggaggctctcaccagaaaagattgtgcccttgatgtgttaagcagcctgtccacttaacccaaaggtctattcaaacagttcaatcaaattgtaagctgtcacaacagcatccaaatacattagggcaatcctgttaacagcagaaagaccttgtctaagcaccgagttatgtttattcagaaaaaagcttcagtcccagctgagaagctgaaaatagacctcaggttaaaaaagataagtttttaagttggtttttgattgtactgattccaaatctatgaacagtggccttctaaggcagtggtcttcaagatagggtcttgaaaacttgttagaaatgcaaatttttggccctgctcaggccttagtgaatcaaactctagaggacatgcccagtaatttgcttttcaacaaagccaccaggtggttctgattcaaactgaagcataagaaacacctctctaggagttcatgcttttggtgaagcaataagaatgctgtgttagttttcacagtgaaaacacattttgcaaattggatttatcatgatcattgaataggttacagttttttagaaagaccttttttttttgtataattactgaaatgcaaagctgaatactactgaattaagtgtgatattcatatcgattgttgggattatttatatcatcatggaaaggaaaaccaggtaaagtataaactgatcattgtaatgttgttattaataacaacaagaaaagaaatatgggacataaatatcaccttcaaaaatgtgggtggtttttcttcaccagagaaaatgaaaatatattacaaatctatttatacagtaattatgccatcttaatttaggttggttaactccaagtagttgaataaaatctgatactattttctaaaattggtattattggttcagcatagaataaccacttccacacttcactacggaaaggacctcattgctggtgccagagagatctgggatgagtctctggcctcccattactgtgtgggtgactttggaaaacaccttaacctttttgagcttctgaggttcaggattttgaagctgttttgctttgttttgtttggatattgagttgataaaaccaaacttgcacagctggtgtgagcagtcctgacaaaggcagtaaagcatgcatcagagtagctgccacaccctggctgtgtcattcacgttgcctcttcctttctcttcaccagtgttctttattcctgctgtacacttgccatctgtgatgcaaatctttccaggcatctctgtcctttggctcaggcatggctcacctccctcagttttcctctgctccttcctctgctgtacctagctcacctccctcagttttcctctgctccttcctctgctgtaatacacatttcatcatgtgcaaacaatcatgtatcctcaaacttgttccttataatgatcatttaatttcctcaccttaatgaaatatgatagctccacttttctagcaattctcttctcactccacagaaaattcttggcgtagttctaacgtattctcttatttaggtcatcaatcatgctcactctaaagccttcctatttaaaaatgaatacagtgcaagcatgcaacctacttagatcctcctcttctttttttaaccattcactttacagtgtcatggggtacttttatttttaatctagtcttcatctcctgtgggtctccacactccataggcagacaaagttctctagtcatcagctccaatctacttttgccatatgtgacagtcaaactagctttcattttgttccttaacacatccctcaaagttttctacttttgtgtatattttcatgcaatatattgaatataagtgtcttcatttctacaatatcctctaaaaatactgtccattaaagcccaactcaaatgtcataatcttccatcccatatcatctgtccattctcttgatttaaactataactgccttgtaatgtatactacttaagataatgggttttgctatcatatcacaattgaaagtatgtatttactccaaaatgcaggcgtctgcctctttccgtctgtgtctatacttatatctaaacatctctattctgtatattttatagagaattcaaattttaatatagctgtagagatgtagacagcataccatatgtatatattctagctatgtatttatgaaatttattgtatttaaatgcatatgtgaatttttaatgttctgtagaagaccattggcaaccatttatcagccttataagagctcatttgaatatgttataatcacagaaaatgaaaaataaaagaagtactccaaaaagcatctttgtcacaaaaagagctgatgacttcttaccaactcacttccctatgtgcttcaaaaattattcaaaagactaaaaatccctgagtcaatccctaagcatctattttcctagttggatcttgatttgtgataccagactggtatctataggctactgctaagtgccagtgaccctacctgtcagccttgtactaaatctcccatctcgtttatacctgggctagtggcttagtctttatgtttactttgctgagccaatgtatttacatcagtcagactgggatttcaactggtgaccctgggtctggcattcattacagttgtctttctaaaaggtaataaaaattttaattttcactaaaattaatatgatacaaataaaaatatgttgaaaaaaataaaacaaaaacagggggacttgtcataatagctaacaaaatttgtaataatatgtaaaaactgatttgcaaatactaaatttaaattaatgtcagattatggcaaacaatttttaatgtttcttatattttggctcacatctatcctcttgaatagtttttctttttatcaaaaagcatactgactaaatttagagatgaaatacttgctattaatataaaaatgcaattgtccttacagaatatattattttctgtatattcaaaatataacccaggagatttaggggaatactcttctttcctatgttcaaccccctgaaaaacaaaaacaaactaacaaaatcaactttaaacaaataaggcagatgggtatatttgacttttacagcttttgagtatgtattcatttaaaaattcatttaggtacaattttaggaactgatttgataataaaattgattaaatttttttaacctttaggttcaagggtccacgtgcaggattgttagataggtaaacctgtgtcacaggggtttgttgtaccaattattttgtcacccaggtactaagactagtagccaacagatatttttttggatcctctccctcctcccaccctttactctcacgtaggcccccatgtctattgttcccctctttgtgtccatgtgttctcatcatttagctcccacttgtaagtgagaacatgtggtattgatgtaggatttttctcttggtcagtttgcaagctggggacccccagccaacgatgtcccacctgggcctcacttgtcacgctacctgctgcaggagatggccacccgtttaaccaagtctggcttttgcaccggttcccaagttcctgtccagcatctaaaaagaatgaggttgctgaccatcaaagagtgagcaagacgggaagttttttgagtgatgaaacagctttcagtggggaggaaatgtgaggtagtccccctacctgaagtcggtaaaagtcctttaacatggctgagactggggcttttatgggctcagaatagggaatgtgcgctgactgctttgtgagtatgcaaaaaagtttaaaggaaagacacaactcaaaggtgggcacaacagtgtggaaaaccaattaggaaagagcaggtatatgtaaaataggggaagggtagggatctatcagagaaaagcacaccaaataggaagacgggttcactatcctgtctgagggcttacctaggactgtctccggcttggaggttgggtttcactggggacccgtccttatagacctaggaatttggctgcctctggcctctatcagtatttggttttctgttactccattagtttgctaaggataatggcctccagctccacccatgttcttgcaaaggacatgatcgcgttcttttttatggctgtgtagtactcaatggtgtatatgtacgacattttctttatccaatctggcattggtgggcatttaggttgattgaatgtggttgacttaatgttcttgctattatgcatagtgatgcaatgaagaaatgcatgcatatgtctttatggtagaatgatttatattcctttgggtatatacccagtaatgagattggtaggttgaatggcagctctgtttttagctctttggggaatctccatactgttttccacaatggttgaactaatttacactcccaccaacattgtgtaagccttcccttttccctgcaacctcaccaacgtctgttatttctttactttttaaataataaccattctgactggtatgacacggtatctcattgtggttttgatttgcatttctctcatgatccagtgatattgaggtattttttaaatgcttgtggccacgtgtatgttttcttttgaagtgtctgttcctgttgtttgcccactttttaatgaagttgtttgtttgtttttttcttgaaaatttgtttatgtttcttatacataaagatgctggatattagacctttatcagatgcataattgacaaaatttttcaaactttgaatgtatatttttatcacattaattcatttactgtatactattgagtgtctattatgttatcatctgtgacatacgctaacaagatcgaggaaaacaaaatgaatgtgaagaactctacgcctcagagagctcacagtcatatgcagaaacacaaagcatatctaggtttactaaatagactggttgtctactactacatattgtagtagggattaggattgagatttatttgcatattttgtacttcactttccccaagattaagattaatttagaatgctattgtctcttttgagatataggatttgatctatatatgtctgccaagtacaacttatttattgagtttttcaataaataagtataattttaagttatagttattatttgtgatatatttactgtttttaaatctccccctacatggatttgtcaatttttaaaattctgtcaatatttcctttctataattttagggtatgattcttcagggcttaaaattaaggttgattatgtctcccaataagatgccccatttatcatctatatagtgactgactattcataatatgttctgtattaatttctcttttgtctgatattaatacaacattatgacttttttcagaacagtatattcatggaataatttaaccatccttttaagttcagcttttctgaattactgtgatatatgtggatctctcgtaaagactatgtggtgaaattttaattctttacttctggaatttcagtatttcaaataagttaaatcagtttttatctattgtgattactgatgagtttttgttttcttatctttcaagtttgctttgctttctctcctttttgttatctggtatataatttaaaaaattatttcttcttaaatatcttgttaatattttagtagtcatttttaaattttaaaatccacacttgagtcaataaatgttaagtttaatttaacaatgtattttcctcaagaattagacaaaaaacttaggcatcattgctaggtatatacccaccagtatataaattgttctatcacaaagacacatgaacatgtatgttcattgcagcactattcacaatagcaaagacgtgaaatcaacctaaatgcccatcaatgccagattggataaagaaaatatggtacatatacaccatggactagtatgcagctgtagaaaagaacaaaatcatttttgttgcaggaacatagatggagctagaggtcattatgcttagcaaaataacaaaggaacagaaaatcaaataccacatattctcacttatatgcaggaggtaaatgatgagatcacacagacacacagaggggaacaagagaaacttggacctacctgaggatgaaggatgggaggagggaaaaataaccaatgggtactagttttaatacctgagtgacaagataatctgtacaacaaacccctgtgatgtgagtttctctagatatcaaacctgcacatgtaccagttaacttaaaataaaacattttaataaaattaggcattacatctgtgtatccttgtagccactactgtgattttatcacccaatgttttagttttactttattcttaatcctctcctctaatctagaccttattttagtcattaatttccaatcaatgattatttagtttaacccaacatgcatacgaacatttgctcacaattgcttcttttaggttttctttctttttattttaagagactgagatcttgctatattgcccaagctggtcttgaacttttgggctcaagcgatcctctcacctcaccctcgtgaatctctgtgattacagttgtaagccaccatggcaggccacagttgcttcttaaatttcaagtttttttcttctgaattaaagtttctagtgttcttcttatgtagaatatattatggaaaaaaaaaaaaaaaacagaaacaaagactgatagtatatcattttgttgttggtttccttcatactggctttagtgaaggtaggttctcaatctttgtcccacaactaccacacacacaataagtttttaccatcctctcccttgaatgaggctttagctgggtatagaatttttgaggaacaattatgtttccttagcattttgaaaatacaatttcatagtcttctccctgttgagtttttctatgcagaggagccaaaattttattttttcctgaagaattatcaactacatcttttgaatatttcatcttcatactcttttatcctctcatttgaaaatttgaaaccattctaagcttattatattttcttttttcttttatatgttgactaccttatcattttgaaatacattctagttaatgtctcagtaattatttccttatgaaagctttgcctattgagtcgtagacacaacattggaaagcaagggtgtgtttctttcctcctatagctattttcctatttgaggacaaattttacattaatttctgggcttgatgactcatggctttcttgaaaagtataaattgagctccatatccatgtgaagtagaggacggggtttttgtttctcacaaattatattttattttctcaaggaagcatcccaggcatagacaagactgtttgaactccataggtcaccagatacttactgctaataaatattttcctaagaatttatctcttttagagtcctggaattataaaagtgggagttttcagttgataaaccaagaacctatttttactccttttgagtctggctttaaattctattactatattgtattatattgccatgttttgtggtttcgttatattttattttatattttgtaaatttcatcttgcttttctatttgttttggagagagaaagattcatgctgttttagtatcacatgtgtaaagagacaaaacccagttttttgtcccaaacctgtcattaatgttttccttacagtactataaaaaaaattaaattaacatatttccaacactctaccttgttttctacttgtgcagtttttactcctagatttcaatattgagatgtgaccaaccagaatattcataagttatttttcacttagtggaaaatattatatatttttaataagggaccattcagaaaaataagtataactatctttttaatcaagcctttatatgactttacagcataaattatttttccttggtgtattagtcagggttctctagagggatacaattaatggaatatatatatatatatatatatatatatatatatatatatatatgagtttattaagtattaactcacatgatcacaaggtcccacaataggccgtctgcaggctgaggagcaaggaaagccagtctgagttccaaaaactgaacaacttggagtctgatgttcgagggcaggaatccagcacaggagagagatgtaggatgggaggctaggccagtctccctattcacattttttctgtctgcttgtagtctatctgtgcagctgcagctgactagattgtgcccacccagattaagggtgggtctgccttttccagcccattgactcaaatgctaatctcctttggcaccaccctcacagacactcccagcatcaatacttcaatccaatcaagttgacactcagtattaaccatcacaagtccactccttgttaacttgagcccatacacatctcctgagatcatacataatcttcaaataaagacaataataaggtcataattatgcctaacttaatgcaactatcccttctacaaccagaagggcaccaatccccaacccaaatactattacataaagttaacagtacttaaatgctgatgtgaagtcaataaatcttatgttacttgataaaggagaaaagaaataaaatgaagatattttcttagcacaagtgtgtacatgcacaaacatgtttttaagaaaagaaggaggaattactcatgacaattacagttcttgtttcttcagctggtcacatggttgtaactggtattgatgactaccttcttctattaccaattctgtattccctttgccttcagcaagcacttcagcaggtcatggttttattgctggtggagtgacccaaaccttcattcctgtggggtctggtcatttgtagtcctgcctggattgggctgttgcagtttcccattaccttaatcacagggcatggtaatactaagagacgccctaatggatctcctgtattccatgcatactcttccttgcctccattgtggggtagtagactcatttcctcttgatagtccaggtcgcttgagaaaaatttaacagatgtaaatattaaaaattaactttcacaacagaaaatttacttttcctgcacaagaatcgagagattgtgacaccacataccagcctggtcaacagagcgagactctgtctcggaaaacaaaacaaaaccagtaaaatcttccaaaaatatttattttaactgggttttccccccctagatatgttcgaaatgaaagacaatagcaagtaaatattgcactgtcaagccactatattatttctttcaaatgacccacaacaactcaccgttcagccctgttactttacatgtttaagtgtttgatacttcctatttttgtggcaccatattatacattaatactgtgaaacattaggaatgtttgtgcctcattaaaatgtgttcccctccaaattctagcaaaagggtcccagtattgtcccttagaaagatagtttttaacattttaaacccatattctcctaattcaaaagctagcagaagacaagaaataactaatatcagagcagaactgaaggagatagagacacgaaacctttcaaaaaatcaaggaatccaggagctgtttttttttttatatagattaacaaagtagatagactgctagccagactaataaggaagaaaagagagaagaatcaaatagacacaataaaaaatgataaggatgatctcaccactgattccacagaaatagaaactatcaccagagaatattataaacacctctatgccaataaactagaaaatgtagaaggaatggataaattcctggacacatacaccctcccaagactaaaccaggaagatgtcaaatctctgaacagaccaataacaagttatgaaattaaggcagtaattaatagcctaccaaccaaaaaaaagcccaggactagagggattcaaagccgacttctatcagaggtacaaagaggagctggtaccattccttctgaaactattccaaacagtagaaaaagataggctcctccctaattttataaggccagcatcactcattttataaggccagcatcatccaagtaccaaaacctggcagagacacaacaaaaaaagaaaatttcaggccaatatcaatgatgaatatcgatgcagaaatccacaataaaataaaatccactggcaaaccaaactcagcaacatatcaaaatgcttatccaccacgatcaagttggcttcatccctgggatgcaagactggttcaacatatgcaaatcaataaacgtaatccatcacataaacagaaccaatgacaaaaaccacatgattatctcaacagatgcagaaaaggtcttagataaaattcaacagccattcatactaaaaactctcaataaactaggtattgatggaacgtatctcaaaataataagagctgtttatgacaaacctacagccaatatcatactgaatgggcaaaagccggaagcattccctttgaaaacaggcacaagacaaggatgccctctctcaccactcctattcaacatagcattggatgttctggccagggcaatcaggcaagagatagaaataaaggctattcaaataggaagagaggaagtcaaattgtctctgtttgcagatgacatgattgtatatttagaaaacctcattgtctcagctccaaaactccttaagctgataagcagcttcagcaaagtctcagtatacaaaataaatgtgcaaaaatcaaaagcattcctatacaccaataatagacagctaaattatgagtaaactcccattcacaattgctataaacagaatgaaatacctagaaatacaacttacaggggatgtgaaggacctcttcaaggagaactacaaaccactgctcaaggaaataagaaaggacacaaacaaatgtaaagacattccatgcttatggataggtaggataaatatcatgaaaatggccatactggccaaagtaatttatagattcaatgctatccccatcaagctgtcattgactttcttcacagaattagaaaaaaactactttaaatttcacatggaaccaaaaaagagcccatatagccaagacaatcctaagcaaaaggaacaaagctggaggcatcatgctacctggattcaaactatactgcaaggctacagtaaccaaaacagcatggtactggcaccaaaacagatatatagaccaatggaacagaaaagaggcctcagaaataatgccacacatttacagccatcttatctttgacaaacctgacacaaacaagcaatgaggaaaggattccctatttattaaatgttgttgggaaaactggctagccatatgcagaaaactgaaactggaccccttccttacaccatatacaaaaattaactcaagatggattaaagactgcaacgtaagacctaaaaccataaaaaccctagtagaaaacctaggcaataccattcaggacataggcatgggaaaagactttatgactaaaacaccaaaagcaatggcaacaaaagccaacattgaccaatgggatctaattaaactaaaaagcttctgcacagcaaaggaaacttcatcagagtgaacaggcaacctacagaatgggagaaaatttttgcaatctatccatctgataaagggctagtatccagaatctacaaggaacttaaacaaatttacaagaaaaaaacaaacaaccccatcaaaaagtaggcataagatatgaacagatacttctcaaaagaagacatttatgtggccaacaaacatatgaaaaaaagcttatcatcactggtcctaagagaaatgcaaatcaaaaccacaataaggtaccactcactccagttagaatgacgatcattaaaaagtcaggaaacaacagatgctggagaggatgtacagaaataggagtgcttttatactactagtgggagtgtaaattagttcaaccattgtggaagacatgtgacaattccttaaggatctagaaccagaaataccatttgactcagcaatcccgttatttagaaggattataaatcccatagaacgattataaatcattctattataaagacatgcacacgtatgtttattgcagcactattcacaatagcaaagacttggaaccaacacaaatgcccatcagtgatagactggataaagaaaatgtggcacatccatatacaccatgtaatactatacaaccatataaaaggatgagttcatgtcttttgcagggtgaagctggaaaccatcattctcagcaaactaacacaggaacagaaaaccaaacaccgaatgttctcagtcataagtgggagttgaacaatgagaacacatggacacaaggaggggaacatcacacactggggcctgtcagtgggtgggggtccaggggatggatagcattaggagaaatacctaatatagatgacgggttgatgggtgcagcaaaccatcatggcacgtgtatacctatgtaacaaacttgcacattctgcacatgtatcccagaacttaatatataattttaaaaaaattacaaatagaaatcaagttactctgtcaaactacacttcttcctcactatatgataccttgctagttaagaattattatttcctaagcccatatatatatttaatctttgccttctacagataaatagaagaaaacaaggttttttttctgtttattttttatatatcttttttctttcagagatgggggtgtctcactattttgcccagattattctcgatctcctgggctcaaacaatcctctcaccacagcctcccaaatgctgaggttacaggcataagccaccatgcctggctgacaagaagttttcatcaagcgcctactccatgctagacaatgtactatgtatgcattcttctcaccctatgatttatcaaaggaggttattgagatagtgtcttttgcaatacaatattgtaacaattattatttaattcattttcctttgcttatgcaagttatagtagaactacattatactgtcaaatcatactgaggatctaataaactaaacattcctgctattcttaacgtaactgctattcttaatgtaacttttactgttcttttatagcgtaatcaattctttttgtttgtttgttttttggagatggagttttgctcttgctgcccaggcaatggtgcaatctcggctcaccgcaacctccacctcccgggtacaagcaattctcctgcctcagcctcccaagtagctgggattacaggcatgtgccattacagctggctaattttgtactttcagtagaaatgggttttctccatgttggtcaggctggtctcgaactcctgacctcaggtgatccacccacctcggcctcccgaagttttgggattacaggcgtgagccacctcacccaggcagcataatcagttcttttaatcaaatacagagattcatacttacaggtaaacaatttgtgttttcccttgcctattttttttgagattgcttaaattactaatttttaaaagtcatattaaccatggtttctaacatttcatcatttaatgttttgattagcatgccatttctaagttcaagtatttgattaaaatgttacagtagatagaacataatctaagcacttttttcttcaacatactaccagaaaaatctatctgtgctaactttggccattactgctagtgaaaacttaattttgtcatctataatattattatttacaaaatcatgttctgagtgctaattttattctgagaaacatactggtgttagttttaaaaaatgttttaaacaactcattaagtagaaactattatacacactttgcatatgaggtaaacaaagtttagaaagcagagttaattttcataatggcacagaactgttaaattgcaaagccagaaatcaaactcacatgtgtctaaatggagagtcccactgtttagctctaggctacaaatatttctatggttttccttggaatcaacatcaaacttgttagtctgtagtttctgaaatctactatgatttacatcaaaataccatggccacgaatcaatttatcgatatttcacaaagtttattaacaatgaaactttgattctgactatagaaatcctctggaatctaggatgtgattcatctgcttacagcaatttgaacatactgaaagtagctacattatttttactctatcttggcttatctagggtttcaaaaatcttttaatattataaatgttaatgataggcatttttacagttaaaaatgactataaaaaagagagattgagacattgaaaagttctacattttctccatcatttgttaatataaaaatattacccacatccaagaaatattttacatttcctttttctgcttcttttttttttcctcgttagaatttttctagctaccttctactgcttcttattatatacttgtgaaagcatcttccttgtctttagtgttttccattaagtgtagcacatccagaaatttgttcttctttatacaattatatatattcatgcaactttaaaacagtttttaatttttttggagacagggtctcattctgtcaccctggctggaatgcaacagcactatcatagcagctcactgcaggcttgaacttctgggctcaaccaatcctcctgcctcagcctcccaagtagctacaactacacgtgtgcaccaccacacctggctaatttaatttttttttgtcttgctatgctactcaggctggtctcaagcttctggcccctattgactctcttatctttaactcctaaactgttgagattacaggactgagacactgcacttagcctcatgcaactttttaataatcttttttgtacaattcaatctttttattatgagaaggatatttatgcatatagattaagacatattttagatactgctgtatcaagtattaacagtgcttttgtattatttaaaacagaagaatgtgccctctgagcagacaaaacacaagagctaccccttcttcggagccgatgctgcttctcttagggtgagtaacttgcctagagagcattatctggatgcctgtcccaactccacccctggctagatagcagcctgcacattctcatgctttctatagtttctattttttcagagagttgatcttcttatgggcttacatagtagttcagacatttcctatcataggatttttcataacaattacctagattgtaactttatgatgtgagggagtagtcatatcttgtttaccattgtatacctgcaaataagatactctgtggaacatatattgttatttacaacatgcattaatattttaaataaggacaaaaattagtactgaaatatctgagaaactcaaattacttattatgtccaaattattttctaactcaaattaaaattcaactcatgactcctttgatatatataccaataaactatatgatgtattatatgttatcatttatcaagaaagagagacattgccgaaatggtggaataaaagcaatatggcttcactgtccccaatggaaaaccaacaacaattatccagtgccaaaattaacaccaacaatatcccagaactcccaatttagtctgaaatgaatcctggagccacagagaagtgaaaaaccatgagcagaagatagaagaaatggacgtctctatttgcaatgcctctcccaccaacagtaaggcaccatgcagagaagtctcccggattcacaatttccatactggatgaagagagattgatgcagacagcccatttcccactcattttggtccctacacaggaaaaccattcctgcctcaatctgtgggaagacttgcgagtgcctgagggagagggcagctggagacagacagtggaggtagggctagtagccccaggaaatgaaactcagacaaataaaatgtcaaatcagagaggtggttcagcagcattattctgtgagaggcacactccatgggccatgtggacaagaccccttagccagtctcctcacacagctgggacattccctttgggaccccactcctttgggacaggcaggccttcaaatttttgctagagctgtgataatactgagttaaggtgccacctagtggcaaaaagagggagtgacctagagctaaaggtgtcaatatgcagactgcacagaacctttcaacacacatatgttagagaaaccaaaccagcccgacaagcaaatactggaataaataactaatcattcaatgcaaatcaatagacttacatccataagaaatgatgacagcaaactgggaacctccccaaacggacaaagtagggaaccagtgtctgattccagcaagatggtgatgtgagctttcagatcaagaattcaaaataagagtattgaggaaactcaacaaaatccaagataatgcaaacaagcaatttggaagtttattagagattaacacaataaaaagcaaacagagatcctggaactaagaaatacattggctgaaataacaaatgtatcagagggtctctacaacagaaccaatcaaacagaagaaagatattgtgagttcaaaggcagaacatttgaaaatatgtagtcaaaggagaaaaagaaaaataataatgaaaaggaattaaaaatgtctacaacatctagaaagtcaccttaaaagaacaaatctaagagtcactgaacatagggatttgaaaaaaagaaagtggtagaaagtatatttaaaaaaaaacaaaacagaaaactttaacacctggagaaagatataaatatccaagtacaggaaggtcaaagattaccaaacaaattcagcccatgtaacactaccccaaggcatataataatcaaactctcaaatatcaggacaacaaatattcataggcatcaatggaaaagaagctaattacatataaaggagctctgacttgtctggcaacagaattctcagcagaaaccatacaggtaaggagggagtggatgataccttcaaactgctgaagaaaaaaatgctaactgagaataaattatccaacaaagctattcttcaaacatgaagaagagatacttttctagacaaatggaagctaaggtaattcatcaccactggatctgtcttataataaatgctacagagagttctttaatcagaaagaaaaggatgttaacatgcaacacagaaaatcatctgaaggtataaagcctactggtaaaattaagtacacagacaaattctgaatgctttattactgtaattgtggtgtgtaaaccactcatacctctagtattaacacaaaatgcaaatgtatcaaaaattactgcaatgattttttaagagataggtgaatataaaaacacacaaattgagatttaagaacatcaaaaagttggaggatggagttaaagtgtagagtatttttagttcattctttgcttttcatttaaagatagtaatttcaacttttattttagattcagagaatagaagtgcaggtttgttacatcggtgtgttgcatgatgaagactggggtataattaatccagtcactcagatagtgagcatagtacccgagttaatttttcaacacttgtcctgttccctctctttccctatttgtccccagtctctatttttgccatctttatgtccacgtttacccaatgtttaggtcctacttataagtgagaacatgtggtatttggttttctgttcctgtgttatttcacttaggataatggccttcagttccatccatgttgctgcaagggacatgattttttcctattttatggttgcttattattctgtgctgtgtatgtaacacattttctttataaaatccacctttgatggatcctaaattgatttcatgtctttgctactgtgaacagtgctgcaatgaacatatgagtgcatgtgactttttggtagaatgattcattttcctttggatatatagccagtaatgggattgctgggtcaaatggtatttctcttttaagtgctttgaaaaatctctaacatgctttccacagtggctgaagtaatttacactcccaccaagagtttacaaatgttctcttttctctacagcctcgccaacatctgttgtttttgatttcttaataatagccattcggacttgcgggaggtaatttcttattgtggttttgatttgcatttctctgaagattagtgatgttgaacatatttttatgtttattggtcacttgtatgtcttcttattaaaagtgtctgttcatgttgttggcccacttcttaatgggattatttcttttttccttgttgaattgtttaagttctttatagattctgaatattagatctttaatggatgcatgctttgtgaatgtttatcccattctgcatgttgtctgtttattttattggtagtttctttttctgcgcagaatctctttagtttaattaggtcccacatgtcaattgtcgtttgtgttgcaattgcttttgagcacttagttataaattttttcccaaggccaatgtccagaggttttctggtaggttttctcttaggattcttatagtttgagggctcacatttaaatctttaatccatcttgagttaatatttgtatatggtaaaagggagggattcagttacatttttctgcatataagcagtcagctatcccagcaccatttatttagtagatggtcctttcttcattgcttatttttattgacttcattgaaaatcatatggctgtaagtgtatggctttgtttctgggttgcctattctgctggtctatggtctatttgcctgtttttgtgccagagtaccattttgttttaattcttgtagccttatagtttgaagtcaggcaatgtgatgcctctggctttgttccttttgcttagcattgctttggctgaattcagcctttgtttcttttcattcattgtgataaaagttaagttattttccatttaaaataactttttataaatctgagatttttttgtaagcctcctggtaactacaaaggaaaaacacacaatggatatgctaaaaaaaaaaaaaaagtaattgaaacatactacaggagaaaatcacttaaccaaaaacaaagatgttaataaagagtaacaaaacaaccaaaaaataacaaaatggcagtagtaaatgcttgcctatcaataataacattgaatataaatggactaaattttccaattaaaagacagactgactgaatggattttaagaaacagatccaactatatgctgcctacaagaaactaacttcactgtaaagatacacagaatgagagcgaaggtatggagaaagatattttacacaaacgaaagtcaaaaaatagtacgagtagctatatgtgtatcagataaaatagacttcgagtcatattattattattaaccagaatgagatattttgtattttcctagacagaaacatttcaccttcactatatgatgcacatactttataatcaaagttagagtagaaaactgtttttctttttatatgaacggtctaagatgttgtttcttacagcattacatttttaaaaaatttaactaaagtcactaattgctacttgatcccaaccccttgtttaataatgaacacatacaaattgctattctttaaatttttctacaaaattattttgaattatttcctcccattggtttacttcaattctcggacccatacctaaaaattgtattcacttctttttattagaatgcataacatttcttattttagatagactttatttttagagcagttttaggttcacagcaaaattgagcagaacataaagaggtccctcatatgtttcctacccctacacatacatagctttccctattattgacatcccgcaccacagtggtacatttgttacaaccaatgaacttacattagcacatcattatcacccaaagtccatactttacgttagggttcagtcttagtgttgtacattctatggttttagataaatgtataataacatatattcatatttatagtagcatacagtgaagaaaatatgtccaggtttattaatcagcactgtatacctttatcagctgttaaataacaacaacaaacaatggcaggttttcagtctccacctattgagaggtgaagccagctgggcttctgggtcgggtggggacatggaaaacttttctctctagctagaggattataaacacaccaatcagcactctgtgtttagctaaaggattgtaaatgcaccaatcagcactctgtaaaaaggcaccaatcggcactctgtgtctagctaaagaattgtaaatgcagcaatcagcactctgtaaaaatgcaccaatcagtgctctgtgtctagccgaaggattgtaaatgcaccaatcagcctcttaaaaacgcaccaatcagcgctctgtgtctagctaaaggattgtaaatgcaccaatcagcactccataaaatggaccaatcgcactctgtaaaatggaaaaaacagcactttgtaaaatggaccagtcagcagggtgtgagcggggccaaataagggaataaaagctggccaccagagccagcagcggcaacccgcttgggtcaccatccttgctgtggaagctttgttctttcactcttcacaataaatcttgctgctgctcactctttggatctgcaccacctttaagagctataacactccccacgaaggtctccggcttcactcctgaagtcagcaagaccaagaacccactggaatgaagaaactccagacacatcagaaggaacaaactctgaaacaccatctttaagagctgtaacactcaccgtgaaggtccgcagattcattcttgaagtcagcaagaccaagaacccaccggaaggaataaattccggacacactatgatgctctgtttttattaagtttgctgtacactgtattttttcattaggtgaggagaagaaatatcagaagcagcggaggaaagagaaattgggtcctctacagaagaggaggcattcagctggatggcttttgaaaagtgtttcctgtagagtcatctgcaatgacttttgtctgagaagtctttgattttatgcactgacatggtttcttgttctgttataaatatatgctgttctagtccttcaataagcctgtcacatttttatcatatctaaaggcactttttctgcagtgttaacaatgtcatcttcattgtcactaatgtcatgatcattttaattcagaacaatttttggctatatttcaataaatggacaactggagcctcattatcaatgttaaaacattttcagtatttacttattccagcttactgacagactctgaaggtatatttttgcatatgtagggtcatatttttttcttttgacatacagaattcttcaaaatcaccactttgtttatcatcaacattgaacataattgcaggccagagattgtgtcaggcatacactactctcttcagtcactgtgttccaagtgttggcaacaatatatacagaattttttatgctaaatttctttggaaaactttccacaaatacacccctgtccaatgtagctagcattttattcagaaagtatatatattatatatatataattactcctcattgatgtaagaataccctgatcacatggctaaattgatgaaatcacagttgagggaaagtattggcaaaaactgcaattacttttgcaccaacctaatacatgccataaatattatatttgataaaaatgtcagctagagaaggagcagaagagtagttaagaagtaacaaaatctcacagttgccatacagttcattttatttgaagtgagcataaaccactggtagaaaatgtttgggcaggccgggcgcggtggctcacgcctgtaatcccagcactttgggaggccgaggcgggcggatcacgaggtcaggagatcgagaccatcctggctaacacggtgaaaccccgtctctactaaaaatacaaaaaattagccgggcgtggtggtgggcgcctgtaatcccagctactcgggaggctgaggcaggagaatggcatgaacccaagaggcggagcttgcagtgagccgggatagcgccactgcagtccagcttgggcgaaagagtgagactccgtctcaaaaaaaaaaaaaaaataaataaaaaaaaagaaaatgtttgggcaaccaatcagaaaagatgtttctggtgatccatgcctttttgttaacataataatgacctggtatgaaattcactccttgaaaatagtaagaaggcaagcttttgtggatcacagcaagtttacattcaggcatgcctactacattagcacatccaaagacagtcattatgcacttggcacccttaattcctgtaagggccatcttataaactgtaatcaatgtctttctggggcaataactccaaaatggtgatgatttatcagcactacagacttattctgatgtcagattttcatcagtgatgattttggcaaactcataaatttctccactgcttcatgtttagcagatgctttatcaccacaaatcttcaaaaaattgatgccatgtcttttcttaaatttctacaatcaccctgttaaatattaataattctcttcggttctcagtccattatgatagatgactgttgcatgatcagcataccatcagctggcctgtgttcactggagtgctgatggttgcacactttcaatacacaatcaagatcttcatttttatctttatgcagtgtttttctattttaacgaacttctgttcatcattttcagcatagaacttcaacagtttttccttctgattcttcaggtcatatatggtggccattcaaatatcaaactcttctgtaagacattttacacttacaacgctgtccagttttctccaatagtttgacattttgtggtatagataaaaataaatgcttcctttgttttcttatcactgttacccattggggtatctgcaggtctatttaacattttcaacaatatctttacataatatgataagaaaaaaaaacataatgagtaatgtatgtaggctttggccccatgtggggtattgtgtggaacatgcctttgacatgtttgggcctgaacaaacatgagttattactttttgtgggtgtccttttgcgtgctttttgtcaggaaatctaagcatgcacacaaagacatgagaagctaaatagagctggtagggtcctttttcccttgggaatgccaagtaaactgtatgttgcacaccagtgttttgactgcaatctgttacataaggtcaggtgtgactttttccagttttggtgtcatgtgagcactcaaaaattttgaattttgcaggattttagattttggatttttggattaaagactttcaacctgtatcttctttggtgaggtgtctgttagggtctttagctcacattttcattgaattgtttgttttgttgttgttgagctttaggacttatttgtataatttggataacagtcctttgttagatattttgtttgttttttttccaaatatttacccctagtctgtggcttttttcttcattttttgacagtatctttcacagagcagaaatttctaattttaattaaatccagcttatcaattactttttaatgaatgatgcttttgatgatatatctagaaattcatcaccaattcaaagtcatctagattttctcatatgctgtcttttagttttatagttttgcattctacatttaggtctaagattcattttgatctaatttttgtcacatggagcgtatgtctttaaattctttttttttttcctgcatgaggatgttcatttgttccagcatcaattgtttaaaagactacctttgctccattacattgcttttgttcctttgttaaagatcagttgactatatttattaggtctgtttctgggctctttattctgttctactgatctgtttgtctactcttgagacaatgccatagtcttgattactgcagtttgtaataagttttgaagtcagatagtgtcaatccttcaacttttttcttctctttcaataatgtgttgtttcttctgtctgagtatcttacctgtccctataaacattagaatcagtgtgtttatatgtacaaaataacttgcctgggttttgactggggctgcgtggaatctattgatatatttgaaaaaaaaaactgacgttttgaatatattgagtcttcctatccataaacatggaattctctccatttatttggttctactttgatttctttcatcagattttgtagttctgctcatacacattttgtacgtgtatattgttagatttatgtcttaagtatttcattttttgattgctagtgtaaatagtgttctgtttttaatttcaaatttgagttgttcattgcagctatataggaaggtggttgacttctgcatattaaccttgtgtcctaccactttgctataattgcttattagttccagaaagaattctgtcaattcttttcaactttctacatagacgattatgtcatctgcaaacaaagacagttatatttccttctccataatatgtataccttttattttcttttcttgtcattggattcgtagaacttccaataagatgttgaaaagcagtggtaagagggtatattattgctttcttcttgatcttactgggaaagctttaagtttctcaacattaagtactatgtcagtggtaggttttttgtagatgtcttttatcaagctgaggaagttttcccccattctgagtttactgagagtttttatcattaaatggggttggattttttcaaatgctttttctgcatctattgatttgttcatctgattttctttacatttaggttattaatatgatggattaattgattttcacatgttaaatcctcctttcatcagtgagataaatcgtccttggttatgatgtataattctttttatacactgctggactcagtttgctaatatttttgttgaggatttgtgcatttatgtttataaaatatattggtttttagtttgcttgtattgtctttgtctgttttgtgtattagggtaatgctggcctcatataatgagttagaaactatttcttttgcctctgtcttctgaaagagattgtaaatatctgataaactctcttccttaaatgcttgatagatttcaccagtgaattcatctgggccttgtgctctctttgggaatgtaactaattattgattcaattcttcaataaaaatagtcctactcagatagtctatttcttcttgtgtgacttttaataaattgtgactgtccaggagttgacccattacatgtaggttatcagatttgtgggcatagagttattaacaaattttttttatgtccatggtatttgtattgctatttcatttttatttttgatattagtggatttgtgtcttttctcttatttcgttagttagcctggttatgggcttatacttttttcattttctctattgattttgtgttattaatttcatttgtttcttctctctctctctctttttatgaaacagggtcttgctgtattgcccatgctagactctaagctaaagcgatcttcccacctcagcctcctgagtagataagactacaactgcatgccactacagctggctttcttatttttattatttcttttattctgcttactttggatttaatttgctctgcttttcggttcttaaggaggaaccttaagattattgattgtaggatttcctcttttctaatatatgcaatttcatatatttccttctaaaccctgctttttctgcatcccacacattttgacagtttgtatttttattttcatttagttcaaaatattttaaaatttatcttaagacagtttactccatgtgttttttattagtgtgtgtgtaatcttcaaatatttcgggctttctcagctatctttccgttattggtttctagtttaattacattgtcacctgagagcagacatcgactgagttttattttattctaatttgttaaggtgtgttttctcatccagaaagtggtctatcttgatgaagattccatgtgagcttgagatgtgaaatctgctattattggaagaaacagtgtatagatgtccatgatatccagttaatttatagtgttgctgaattcaactgcatccttactaattttctgcctgctgaatctgtccatttctgatagagggttattgaagtctaaaactataatagtataatagtagatgcatctattacttcttgctgttctgtcagtttttgcttcttgtattttgatgttctgctattagaaacatacacattagaaactgttatgtactcttgatgtttctttaattttctacagttgaaattatgtgcctagatgtgttgttttgttttctttgtttttttggcgttatgctgcttgatgttctctgagcttcctgaatctgtggtttagtgttcaacattaaaggacacgctgtaattattgcttcaaagatttctttttctttcttcttcttctggtttttgcattaaataaagtttcgttttgtggttgtctcacagttcttggataatctatgtttttgttgtcgttgtttttcagttttggagatttccatagagatattttcaagctcagcaatttttttttcctgaaccatatcaactaataagcccatcaagtggcattcttcatttctgttacagcgttttaaatctccagcgtttctttttggttctttaggaatttccatctctctgcttacatttccgatatgttattttatgctgtccacttttattattagagcccttagcatattttttatgtcataagtttcttcatgaacacatctagtgtgccacatgaattcgatccatttttcaaagaaagtacatctcttaaaatgttcttcctatctaagaatgaactaaaacatctttatttcttaagtagttggtgtcttaccatgacgaaaggtagcaaattcagatccaaagtacattatcataattaacaaatagcacttgttttcacaatctctgcatcattaggagccattatgaggaaggaccagggaagaatttgcctccagcatattaattagagttgctttaaattcttagtctaattaccacacccttgccatatctgagccaggttctgattttgctctatttgttcaaacagtgatttttcctgttagtatgccttgtaatttattcttgatagccaggtatgatatactgtgtaaaaggagcttctgtaaatgggatttttgtgatgtagcagttaggtgtggcgggaggggaagcattctatgatcctacaatttggtcttagtcttttaataagcctgtgcctctggactgtgagtatcacacgtgcttttctgcccccttttaagtgagacagataggtaaaatgggctgtggttgagtatttctcttctccacattggaacctagagtaaagaagagttgtatatttccctttctccatgtagattaggctctggtaaaactccagcaggttaggctctggttaaatagttttttcttagtgaagacattgttaagaagaaaagaatgtctagcatatttcaaaatggttattttgccctttccctgtaagaagaatgaaataattttttctgatatttaccatgagtacaaagtcaaggttctggaaattacactcaccaaaggtggggacatccttatgactgcctcagacttgagcacactgagcctctagcaattcattgattacatttcaggtttcctaacctggtaccaatttctgtggtgatttctgcacatgggtttctgctgcagtaagttgtgattctctgcatttgcttgagggtatctctaattttgagggcagtgttttgtgctgtgatctcacttgtcttatggatctaagaagagtttttgatttcttagtttgttcagctttttacttcttgttaggatgaagtgggaacttctaagctctttacatgctgggctgcaaattggaagtttctatattttctgttgaagttaatatgtgcattaatttatatacaaactatgggtaaggtcacaagtactatcgttagcacttattcctattattccctattaacaatcctgtacattaggctgttcttgcactactataatgaactacctgagactgggtaatttataagaaaagaggtgtaattggctcatggttctgcaggctatacaggaagtatagcagcatctgcttgtggggaggcctcaggatacttccagtcatgaaagaaggcaaagggggaataggcacatcgcatggtgaaagctggagtaagagagagcgagttggggagatgagaggtgccgcacacttttaaatcaccaggtctctcaagaactccctatcatgaagacagcactaagccttgggggatccatcctcatgatccaaatacctcccaccaggccctaatgccaccactggggattacagttcaacatgatttgtgggaagagataaatacccaaactgtatcattgtgtagcaccagaatctcttttatttcacttgaaatacctgatttcttctaaaatatctaatttgagtaatttacctatatttcttcctcctttataatttatcttaatatggtttatcagttgattatttctcccacctcattattttctgtcacttttttttctttttctttttttttttttgagacagagtcttgctcttgttgcccaggctggagtgcaatggtgcggtctcagctcacggcaacctccacctcctaggttcaagtgattctcctacctcagcctcctcagctgggattacaggcacctgccatcatgtccggctaattttgtatttttagtagagatagagtttctccatgttggtcaggctggtctcgaactcctgtcctcaggcgatccaccttccttggcctcccaaagtgctgggattacaggcaagagccaccgcacccgggctaaaataaatagatatttggaagtcctgttttggtcatttgtgattacgatagtaattacaacttaccccatatgctaagaaaagcaaaaggactataacatagggattattacattctgtctgtaaacagggaatgtaaaatataatgagtatatttactgcagatcacacacctaaagttgaggaagcagagaagccttctgccactttttatatagagtaagtttttctactattaaaatttattgtcctactatatttaacataacaaatattcaattcctctttcctatttccgctccccagatctataccttccaataaaaataagagagccaagcacttgtcatgcataatatacagcattgttctgcacagaattataaaaatcactagagaaaggctttagatcagcagactctattaaaagtctaaagttaaatgggttggctgtctcccccacgttgcacatattctttccaggtaaagctcatgccattcgttgtgtcatatgtacaagtcaaaactccatattcctgagctgggaagtaccgcatactacaacatttagtgatacttgaattactagaataaatgagtgaatgactgtgtgaatattagttagcaaaagggccctgtacgtccttgtctttgttagtatttttattagtagatgaaacatcaaattctgttgcttctatttttctcaattcactcttcattagatatgatttgtaattgtttacaaatcatagttttccttcctttttcttttttctctgttaatttttctttctctcacatattattttcattgatattgtctctttcccttggcagctatttttctttctggttttattcttgcattatttctcatattctttcttgacaaaattttagccttttagccttttaaaagcctcagcacatagagaaatatttctgcggccctttaaccttatcctttagcagagagactagcttgcatttatagcatagataattggtgactacctcaggcaaaagacaaacttagcatgtaccctgcaggttcctgaaatagttcccttggtgtccatacttcttcaggttaaactcaagtactgtgtgactctttctggaatctctttctgctctgtcaaaccacactgacagctggttgtgcccatttgctggggactcacgatctctagggtactgctgcctttaagataggctgaccactataatctcctgatgtaaatctctaataatatgttcactcctactatttatcaataatttgtgcccaagagatgtcaagcctgaccccttttacaaagcctgtattatttagtttacatcttcaaaagcattgctgcaaaacattccattaaaaaactatcatctcttttgcaatgcgtatatgcacaaagcttcaaggtgatttttgtgtgtgtttgtgcatattagattttgttaccatgtaactgagcacattggaacatacatgcctgccaaaataagaaggaatttaaagcagcttgctatttatttgaagaaaggaaaattggaaagaactatatgctgtctccaccccattagtaacttataaattactattatctctatttaaccatacaaaggataaaatctagagtcatagaaggtaaacgaagaattcagaaataatcctaaatgagaaataaaatcgatatattcaatttgaaattctagcttgctagtgatacttctaattcttaaatagtatagtgattctttcttgcgcacacacatcaactgattgtttaatgatgatagtttagaaactggctaaaatatattattatagaatatttgaaaattgataactttttttattataaaactataattttattttaagaatcactacgtttttatagtataaattgtgaaaaagtaaaacaaagtatagcaactttcaaggaaagatgttcatataacctgtatgtcttcataattcaatgccacatatcatggggtcaaagcacattccaaaggataaaaccacacctttaaagttttctatatcaaatgcatgagaaagaaaatcattccttctgccataaaatttcaacttagttattcacagtatagcatcttcacagaacaacctggaaaagaaattttggtgaataatttataagtcaaaagtaaagccaagggagcaatccaatatatatatatatatatatatatatatatatatataaatgttatcatagagcacatagaactcagacaacatatcaaagtgtaaagaaaagcaaacaaaacaaaacaaagtttacatttacatgagaagtaaagattgcctttaagaaaataggtaggtcataaatataccaaaatgatgatacttggaagaactataataggtttaaatgttttgaaagatatatgtgtaattaaaaaaaaactaaacacgtctatgaacatttaattcttaatattttcacatagaacaatttgtgctgctgaaacagaaaaaaaaataataaagagaaccaattttcttcttcaaaatgataaatcaaagccaatagaatttttttttctttttcattccaacattcttgagccttctatggttcatacagttcaatcacttatttactgtcaacacccaacccatagttatttttgtttgtttctcattatgcttttatacacaaggcgtcaatattaagatcagccttcatcagaacaaacatggatagtggttgctatacatttgaggattctggacatgctatagcaatatgtagactcaagtgttccataatcacttacacaataaaatggggaaaatatattgacttaaatttatcgctcaagatacttactagtatctttaatactagcttataatagtctgtaagattagttaatataagaaaactatttgtggtaaaatagacttttattcagatgcaaatggattttaatcctggttgtgccatttataagttatgtaattttggaaagctatgtggaatctcagtgttcacatctagtaaagggacataaaatgtatacttgttgtgatggttaatgttatgtgtcaacttggcacatggtgtccatccagagtttgctcaaatgccggtctagatgtcactgttaaaatatattttagagtcgttaacatttaaatcagtagattttagtgaagattaaccctcatagtgtgagtgggcctcacacaatcagttgaacaaagcctgagattttccaaaatggaaggaattctacctcctgactgccttcagattcaaaactacaacactgactcctgctgagatttccagcctgctctcccgccccagagacttcagacttgccagtctccacagttgcctaggccagttccttaaaaatctctctctgattgcgtgtgtgtgtgcatttacatccatccatcctattggctctgtttctctggggaaccctaatacaattttactatctgatgttgaagatgcaagtaaaaaaatatgcatcagatggcattctggtcttcaatttgttactttatctatgaagacagcccctgtatacggagaatcaacaaaataaatttgtctccctcccagtctcactagcaagcacagctgcaccactcacctgagagtccatctgcctatttcctattggaactaagatgtctagttcagcagagcacaggggcatgcagacaggaggcaaaaatttagctattggatcactaggagtaatggaggctgatgcaactcccattttcaccccttgattcctggacctgtgaatcctagctatattagacattaatttagagcatatatagcttcctggagaaccttgccccagccttacaagcattgtcacctagctggcactgtaactgagtcttctaatggcccttccaccttttttttaagccagctgcttcaggatggtaaacaataagactagtcaatttcagaagcatggcctcactgttgcacttcatttcacgtgaagtgagttctttgatcagaagcaatgttgtttggaatactatgatatgatgacagataatgcccattcttcaataccacagacgatagccttggtagaagcattgagtatagatagagtcgtcaaatctatacccaaagtgtctatttcagtaagaacaaaatgttaccgcttctgtgatggaaacagttcaatgtaatcaacaggccaccaggtgctagctgatcaatcctgggaatgttgccatattggaggctcagtgttcttctctgctgctggtagagtgggcactcagcagtggctgtagtcaggtcaaccttggtgaacagaagtccacattgctgagcccatgcataacctcaattcctgccaccatgactactttgttcatgaccccattaggtaataaccagggtgtctagggatggaggctgagtggcatcaagaaattgcatcatcctatccacttgagtattaaaatcttcctctgctgaggtcactgtttagtgagcatgcttatggggcacaaatattttcatgcattttgtgtattcagagaactctagccacatacctatttcccaggcttctttgtcatcattttaccagtcacgttcctttcaagtcccagaccttacaggccacatcctatgaatcattatataattgcatatctggccatttctccttccaagcaaaatgaataactaggcgcacctctaaaatttctgcctaatgagagaaattctcttcaccattgtctttcagtgacttcccagaaagaggctgttgtgctgtgacggttcacttttgaatagcacccacatattgcatagtgtatttggttgattcttataattcaagtactctcttcacagataaactaacaaaatgaagatcaatacagcacatatttgttttggatcttcaaccacagataataaaattgtattagagttctccagagaaagagaaccaacaacgggtgtatgtgtgcatttacgtacccacacatgcacacaaatttgcagagagagagagagagagagagagagagagtttaaggaattaccagactgtgggagctggagggtctgaaatccatgaggcagatttgcaggctggaaatttcagcaggatccagtgttcagtattgagtttaaaggctgtcgggaggcagaattccttcttcttcagtaaacctcagtctttcttcttaaggtcttcaaatgattggaaacagcccatgtgcattgtgaaggatcatttgctctatacaaaccctactgatttaaatgacagtctttattcaagactgtctactactgatttaaatattaatgacatcttttacaaagaaatactttcatagcaatatctacattgatgcttggtcaaaccactgggtatcattgcctagccaagcaacacataaaattaacaatcacacttgtctgcttttaaaggtgatcattaagcccaaattaaataacaaaggtttagtcagacacttagcacagtctcgtacacagcagcctttttactattgctgtatgatactaccagtactaacaacatcacaactaaaaccactcctcatactacccctgttgctattactggtacaaatgcaggcatatttgcatactctcctacttgttttctaaggtttactgaaacataattatttgttagccaagtagctcccacaccaatccattcaaattccttaaatcttgatcaactcagttgcatgttacactaaacaatctccttttatctaccacctaaggtgttggtatcactagttttctcaaagaatttgcttattactttttgtgtatcatcgagtcacatattctatggaaagaagcacaggagtcttggaagttaataatcttacattcaaaattctagagatagctacataaatcttcagcaaactactttttttccaaacctccatttctgctttgtaaattgcagacaatatgatcaatatgatctatgtccaaattttactgtgtatacttttgaagctcaatttattagcttacatagactcaaatttgtatttattcatgttttgactagtcttatactccatattggagacaagcatttttttttttcttttgagatggagtttcactctgtagcccagactggaatacagtggctggaccttagctcactgcagcctccagctcccaggttcaagtgattctcctgcctcagcctcctgagtagctgagattacaagcacctgccagcatactcggctaaattttgtatttttagtagagacagttttcaccatgttagccaggctgatctcgaactcctgacctcaagtgatgcacctgcacaggctgcccaaagtgctgggattacaggcgtgagccaccgtgcccagctgagacaagcatcttgtgagtagcattcacctatgtgtatttcagtcctttctcccctaccttcatgacttgcacactataataaagtaccaaactatgtaacaattatttaaattaatacgtctttatttaacctaatacattctaaaataaatgattaatgcatgttatccttccaagattcatggtagagaatgcagtagatggaaaaatagtacactgggaatgcaaatagaggaatggagatgggccctgtccgtgaagcaagcaaaaagattctgaggacagaaactgatggtaactggagaagagggtacccaaagcgaaatcttgaaattgttcattttgacctggaacactgctcaaccttattttgagcctaattgtccaacagttttatttagtaatacattagtttttaaaataaaatgtcctgtagcaacagagcctgaggcgcattttaactgctaatacagttttggaaaatgcagtttcaagacccagaatagggatgcatgaaagaatccagggaagagggataacagatatgagggagtgccccactgtgtttcagagaagcacacaaatgttgcagttttacatcatctctaaggacacaccttcagggtttactcctcatcccaccatttaggatagggaaaaatattggttgtgaattaaaactgaaaataataattccacctataattagtacatctttacttatacttgtctattcaataaaggaagatatttttatatatttgtaactatttcaatgaatagctttaacatgattaaattaatacacaagtttggggtttcttaaaataatctttaaaccaaattttaacccaacaaatagaaagtagattccccctcaacttctttttgaatttaagattaataatcagtcctcctagacatttcttttatccctaagctgcccctataataagtaagcaggtcaaaattatagacaattactcctttaaaaaattatgtcctggcccagcattttcttattaaactcaatacagttactgaagcttttgtaaacaacctgtgtttcttatttatttaacaaatatttgcttattcatttaacaaatgtttactgagtacccactatgtgccaaaaactctattaacacttaatatacagaagtcaataaggttgatcagtctctatgttctgaaacttatgttctactagagaaaagcagcaataataacacaattaataaataaaactggacattttctcatttccctaaatgttgtgaagaaaacaaaaaggttaattcaaaagatagaaatgtagaaggacggggagaaatttggcactacagaatataggctgtttaaagaagaaatacttctctcagaagcaacatttgaaaggtgtcctgaaggatgagatgaaatctccaggtctgagaagcagcaaggtagacagagtacagtaagcagaaaggttctgaggatgaacagaagtcagcactgaagggatagcaggagaaaccggtggaggaataaggtgaagttggaaacacaggctgaagccctagaccatagaggaacacgggcggtgctagagctgctcctgcaggctcctgctagctcaggacagccaaccgggcacgcccctttttaactccacgttcagtgaggtcacgttggttgcctgaaattgaacacgaaggacatatttacactgtgagatttaccaaagctgcaaatcactaacccaaccccacatcccaacacacacacacacacactccaggtttcccaatgtatcactagacaaatagaaaaagcaggctaccagtccctaccttgccagtaacagttttaagtataaatgaacactgtccaaaacaaaggcctgcacacttatttcaggctgaatattttagaattagggaaactgtttcttccacttcccttgcttgaggatcatcatgaagtttttgtgtgtttatatctgctcctctgagagtctgtgttgggccaataagtgtcactgtgctcccctggaacagggataggaccatggcaatcatacggctacgacacaggtagagacaagattttcagatgcaagatacgagtcaaccagtcacggctgaatgtgggcagaataaatcacatctgctttctcctcagaaagatacacgagtaggtcatccagagaaatgaaaaaagaaaaaggagccaccaactagatatcatattattgttccactcaaatttaccatgtctagaaaacttccaagaatgcactatttcagttagtttgttaatatttatttctgagggaatgcatactatattacagtgaatatgaactttggaatatcactaatttatgttgcagtacaaactatgttgttaactagttgagtgctttggcactttgcaaaacatctttttaccttggtttcagcatctgagataaatttgtatctacctcatagactttattaagcactcaaagcaatttcatatgtaacaaatattaagaacattctgtggcacaaggtaggatagataggctggtataaaaagtcttgacttcacaatttggcagactttgattggaatgctgtccttgccagcagcttaagacttcaaaatttcggtgaatctcagttttttctaatgataaatggggataataatatcttgcagtatttttgtgaagattagaaagatgtgattctatattttgtatgatgtgtgcatagttggcaaacaataaataatggacttgaatttcattagggctatcattcaaaatacatatggaaatgcattttttgagcaaaatcaaatatcaggtataccagaccagtgttaaaccaaacaaacaaaaagctggcaataactttagatactaggatttgttttgatgcacttcttttacatgtttgttttctgtaccattcaaatttaggtttaaaagctcttggcgaaaattgaatcttaaggaaagaatggcgtatttccagattaaggtctttactaaagacagggctcataaattcctcctcagtgtaagctttcaatcccttctgcttccatgtcaatttatttatttatttttttttaggtaaaatagtttttttttccaaaggaaatttaaggaattttattatttcctagaaaagctaaagtgaacctgtggaatttcaagagggcatacttataacaatattagacagctttataggttggccataaaaatctggaaacacagcaaatatacctaataaaaggtttgtccatgtgaatttattatgatgatgtttacaactgtacatgtcctgagactggaccgcctgaaggaatagaactccttaaaatctggggagaagatttgattgactcccctcttggctctctcaaaaatttctaaaaccttccccttggagaccacttccatagaaaataaactccttcgaaaaatttgccaaagctcattttagcagcattcagaaaatgtgtttgtcctaattaatcaagtctatttttaaaaggtgataagcagcagggctgttttgtatttacttattaaataaataatttgagtttttcttctttgagactctttgtgtcctttctctctgccagaaaattgtcaaggttttttccgcaggggttcatttgtggctctgaaagttatagttattgcacatcatgaaatgtgtctactctgaatttatcattaacacgttatatggccatgtaatttatgtatttcctactctgaactgaagagagttctcagcttagtgtttgcatcactgttttcctttgttgatgtctttaggctgagctatctaaaaccttctcccagctgcatccaggacctttaaatgttttgctctctactgggaccagctaaaagaattgctttattgcatgagaaacattgatgatgcaacaagctcctttctttagatagaccctggctggtgctctacctgctttaatatcacctttgcacagcccacagactgatgagccactagctgcacactgatctaataaagaccctaatatagctgctatgaaaggtcaccgctcttttccacacaggcaagaaatccgattgcactgtgtaaacagctatgccactagatgcgcggcaagattttgtaatccttgctccttcaagaataaatgtttctatgtgagctttacatgagaacaagagacctgagccaaagtaactaaagtggatttccctgcatttctgatacgtctttgcaggcttcctgccctcaggatagccatataatgtatcctttcactggatgtttacctcctagccagttccgaaccatagtctgcgcccatgaggtcttcacattcctcttccctatcaacactgctttaaactgtgtccacagatgatccgttaatctactttcaactgggttgttatgagttgacaaaagtttagtatgtcacccttaccagaggctctttggtgttttcaaaagggagctttaatatcaaaaaggaatgaaatcagatggctttttcctcaattgctgcactataatgacctaacatcaattacattaacacaaccactgatttattttctttattccacactaggctggtgagttcctggtgtaggtatgatgttctatttgactttgtatctttagtactcagagcagtgcctgacacacaccaaatgcttaagaatgtttgccaaatgaatggatgaatggttaagcgatgttcaggaattgtaggccaacaggatgaaattatgtatttgggaaataaaactttgtcagaacaatttgcatttttttaatttgcagccatctaagtgaggctagctcaggcctctaacatctgaaacaaacaaaacatatactcctggacattgttggaacagagtccggagacaggtaacatacatgtgtgttctgcaggcaaactggaaacatgcaaatataattcccttaaatgagaaagaaaaggaaatcagcaaaccggaacaaaccctttcttctctcaaagtcacaaggagagaagtgttgtacagagaagatgagcatgtcattttgctttaaatctgtgccaaaatgacatagtaagaataatagcactctaggaattttgtcattaatatacactatctgtaaaaaatgaatccatgcatttatttagaaatttgttcattaatttttcccctttaaaagtaatgtatgcttgtttttgaatcagtggatttctaaatgaagtacagatgttaaaagaataaaaaatcttaaatagctacattgtctttcacatggtagctataaacatattataatttataattaagatttatttgtcctctaagaatggcttttaaatgtcatttgaaaaaaaaatcaagagtgctatgtggagaataaaacaatgccatctatttcacaatttcagatactatttttcttactctatggcctttaataccatgccagtatatggggaacaagggtatgtgtgaatgtgtattattactgctctaggatactgtagcttctgtgttttgttcatattttatctaaaggcaaatcacaacaaagtgcaaataaaaaaatgttaccttcattctataaatattcatcaagatatgttttggacaagtgttaaaattgggaaatgataagaattcatagactacagtactggaaaagttaaatttccctctcactttagataaaagagggagcaagaaaagagaatttttttctagcactataggctatgctgaactaatagcaagaagtagtgaactgatagcaagaagtagaataaaattgaaaacacagaaataaaacgttcattaaactggtatccatttttggagagctactatgtagcatatatcaaccacgtgaaagcgactactgtacggtttctgggaatatgtggtgggagtcatttattcactgagtcaggacttgtttttggatttgtaaaagatctttgcaatggataataacacagtgtcagccctgtatgagaagactaaatgaatgatgaagtctaaattgtgctgaatgattgcaaatggatcaaatggcattcaaaataatacctcaattttttatcaggactgtgactgtacttccaacctttcagatatgcattctttatggtacaaaattatgctacataaaattagtaaaatctgttgtcatagaaaagaaaaaaattatagaaaagtaaaagtagtgaaatgaactgctgtaaaaagagaaccacagagaaaacagcagctcaataatgtgtagtcaaaaaatatgctagtaaatggaaccaaaactctccccacctcatattctattatttatttatactttaaaagcctcaatggatcagagctaagttttatcatttcattttctaaagacaacacacttgtttttattcttctctcaatgattctacctaaaaataactggcttattaaaacatacatagaataaatatcctgagaaacttcactgggaaaaataagactatagggaaatttaatttaattatagatcaaaattattgtgaaatttgtatccatgtaaatcctatgaaatggaagtatttactccatattattttgatatctctatggaattaaaagccaaaaagtcttttgccaatgcattaaatgctattggaacttggtgaaaagctttcacacttcagcaacattgatttaaccttgaaaattgtactgaaaaagtaagagctgttgaatgtatgatatacaaggaagttagcaaagaaatctaaggaacaccgggaaaacaaaaggatattttgtgtctctctcccaactctaacattagccctaactctgagacaatgaggtttctgaagcctaccatgtatataatggcttcaggagtagctttcactacaacttaattaagcttgagtgaggctatgagatcaatgttcccttggtagtggcatgagcaataggtaattcctatcatggtcagtttcactgctgtatcttcaaacacactctaagagtattttgaggttagaatgacatttactttgcaagttcactttttcttttcttttttttttttttctttttacagctactctcatcttgtaaagaaagcgaaggctaacattgaatttccaaggttttggaatgacctgtgtcagaactcttctggcatgaaatattatgcattattcgtaatgcccaaaaccttcaaaattcaacaagcatgatttaatttcaggtcagtagataaaattagtatgacatttttggcattgctattaatttcaataataaaagaaacacaattaattatatgaatattgtcagaaaaatccatttaagtaatatatttaagaaatccaagcatatatgcttaaactgtcatttgtgaaaagcaagtaaaaagctttgtgtgtttatgatctagtaatacttaattctacaaacttttttcttttttatgtatttaataatctgactagaaacttattttgtcagagttagagtggatgaactgacatttcagaatccaatctcttatgctctatcttaaggttcaaaacctttgatcaattatacaatagcagcctcgaagatcaaagaatccttaattgctagtgagcaaatatggggaagctgaataatgctggaccgaggcattcataacacgaagttacaggagaaagagaataatgatggaataatggtggaatatatttatttttccttttttgtgtgtgtacaaaataatgatggtgtgaactgatataattctaccgaaggttatcaggttcaaattttaaatcaaacataattctaattctccttgtctttaaaattattttagagcaaaaaatcaatacgccataatgtcaggaaattttttaaattaaaatgatatccactaaattccctcttggagaagttctgcattagtctaaaaatgcacccactataggccaccagatggcccatgctcagagatatcaaattaataagtaaaatgtatttaagaagaaatatttccataactcaataaatcaaagtttaaaagaaacagagtagttaggctgtgaaatacattagtcacgcatggactatattttgtgagtattttcaaatatgttaattgcaggggtatgggaaaataaactcgtttttcaaagataaactatgtaggtaaagttgttttgtgtatcatgaagaataggctttaagtgtgctttgcagccaattttcttaattaatatagacaacttaaacagattacaggtatttcttgcttattaaaaattcccttcataagctgctaaatttagaagaataaattcactctaggaagcatttgttgaatttagaaaatttgagaatagcatgctgacatctggtacatacagctcatgtgtctaatcctctttctataaattattacttgtatttgtttcttgagaacagttttaacaagtctgtgattaatattggtcagctagttccattgacctcttctgccttttactccattaaatcaaatttcttattgcctaaatgtctccagaatgtgtccaggtatatgcgttgcatgttagagtctatttattgcattcaaaagtggcctggtgtttccaatgctgtcaagtagtgccagaaaatatttttgagagtttaccctgtagtgggaatctttatgtggattttgattgcattgtctgcactgcagaggaatttctacagcctttggtgaactttacaaggtttttatgcagtgaagaaaatatgtataagtagaagtccagcaatgtaagtgagaagaaagaacttgggaaattttctaatactgcagaattattgtgtccatcttttaataagtagaaagtagtacaaataaattaattgttcattaatccatatagactattctgttccacagtgggggatgtcaccttacacaagaaagattcaggaactgcattttcatttcacttacgtggtatagtggcttatgtggttgaacttggtttgcaggaagtttgctaaattcattttctcctgagctcttgctgcacacaaactagattatattcactcaaagaggatagaacatgtggaagagaaagtctgtccatcaacaaaccatggagattacatatagtatttctcatacatacttaaaatataaggttggcattactatatttttcagcaattaaatggtcctaggtcccagaaatatgtttttcagtgatgatccgcctagtacaccttacaacttggtctctggagagtatattagctgaccttcccagccaaaggagaagttattctgcctttctaaaactgttattaagattttacgcatctctctttaaacactttctgtatttttggagtgggtgcagagtttctagcaaaactgcttaaaaccggtattcacaatttttatcccacctatttttataaagatagaaaacaatttcctatacattaatctatggatctatttctttctatctatacatttatctatgatctattcctactaatatataaaactatatatatacacacaattataaactacatatataactatgcatgtaactataaaactacataatatcatatcaataatgaaatcggacttgagttgagatctgattcagtggtagttcattaagcatagaagaaaaaatattccagacagaactagaataatgtgtaaatttccatggcaggagcaaagcaattttgagacactgagtataggtcgtgtggcttcagcacacaatccaaggatgtgtacggtccaacagcacacttcggatttaagggcagatagttacgtgacatttttgctgtgtgaagtattctggtgtttattctgtgagcaacagcaaagctttaagatgttacaaaagattccatcacagtaagatttacttttcaaaatatctactcaccctattaaaggcagagaaaaaaaattagggtggtggttcatgaatattaagataactgaagcttagacttgagaagtaaaaatagatatagaaagatgtagacagtgttaggatatatataggaaaaatatggctagaacttgttaatggattggatacgaaaggataagggtagagaggcatcacaatgacactggatttccggcttacatagatttcataggttgggtttttggatgggactaattacaatttagaaacaaaaaaggcttatttgatgagaagtttaaggatcaggagttccatttgagttttgtaagtgtcaagcaggcaagtgcaacatggtgaagagttttttccaggagacgtgaatatggagccattcatatttggggataactacagttatgagaatgtgtgtagagatacagaatcatacaaggaaaggggacctgattcagaggcgcctgcaactctaaaattcagtggctggttagcggatgagaagcctacaaaaatgtctaagtaggaggaaaatcaggacattgtggtgttataagaagcaaagaatgaaatgatttttaaaatcagagagtgaattaacacaacgctatggcagagtgaaaaaaagataagtctgaaaaaatttcttctgaatttagaaagactaatactatgaatgaccttgatagagttctgttaatagaataaaaagtactggagccatgtttgagggcatctgattgaggtgaggacgtgaagccatgctctgaagggaagggaatgtacagggtgaaattatcctacctatgtacccagttgcacattccaacacaagactacttttagaaacaacaaaaatcggctgggcgcggtggctcacacctgtaatcccagcactttgggaggccgaggcgggcggatcacgaggtgaagagattgagaccatcctggccaagatggtgaaactccgtctctactaaaatacaaaaaaattagccgggcatggtggcagatgcctgtaatcccagctacgcaggaggcaggagtatcgcttgaacctgggaggcggaggttgcagtgagccgagatcgtgccactgcactccagcctggtgacagagctagattctgtctgaaataaataaataaataaataaataaataaataaataacaaaaatcttctttagggttatttttcattatctattttatttttatcccacatcttactgccaaatcactttcaataatattctacctctttctcaaattcctttgtcaagttactacaacacagcttcaactctctcactgtcctcacaaatgttccccgctttctattataatctgtagtgtataatgtcgttcccaaaggccactttgatttcttctcctatttgatttctcaaaagttgtttgaaactattaaactcacgaatttctcaatatttttaccctctattattttcccgaccccactctagtagatctcctttccagattttttctttcatattctagccattcttttgatatggttccaattgtattagtctgataggactactaaaattctacatgaatgactgggcaaagaataaccccatgcatgagcaaaggaaagagcagaaagctaatcaattggagtacacacaggtttttgagacctgaagcttacaaaactcagaggtctttaagtaaaacaactcaagctatatatgaaaaaagtaactgtgaagaggaataaagtttctaatgaagttctaattttttagaatgaggaaagaaatcaaaacaaataaaaaaatttcacaaaactgtcaaactgcacaaacaccacatctagagtaatgcaattctgcgacacctttttcctattatttttcgctgcatatttttctaccagctctttcatatgacaatatcataaaatatttttgatagggaaaaacaaaaataatgtagtttctctttagtattgttcataaaaatttatttttggttttcgttagtttacttaaatcttcagaacatgttttagattttttttatttttgtcaaattagagaaaataaattttcatatatatatatacattaagatttcaggatatttcaagtttttttgtgcagagtcaaaactttactactgtttgaatttgcaatcttcattgatcagtttgtcaaaaaaggagtgtaatacgctgagtttatgttgctttgtatggtaggaatcatcctccatttttgttaggacttaatgagaatgaattctctgccgacaaccctatacatctgatgattggaacaattttccataaactagctttgagctcaacaggtttcaaatcttgtttctcatttaccctagatactcttgtttctatcagtcacagtttggacacttagtttcctagattacatgatgaaatttgtttcttactttactaaagttgttcaccaatacattgtggtgatttgtcacaatatttacattccttgtgtgaaagaatatctgggatagccatttacatctttataatttgcaactttagttattcaatgtgtctcaattcgagagttgacttttttcttgagagctgagttctaaaataagtgacagaatttaaatttccctttgtggaaatactaatgactttaaatgtaacattctctatgaacacatgtactaacctaggttagaaataccatagtatattagataattgatattcttcattcattcactcattgaactaacaactattcattgaggaacttgtgttagtctctactccattgctgggaataaagtaagagcacatgcaaatgtacacacacacacacacacacacacacacaacgcttctaaggtgttgaagaatttgggggagatggcattaagaaaacaatgatctaggtaaatattaaattcagtttttaataaatgccatgaaagaaagtataagttttgcctgttaacacaagaggttaagaaaaatatcttttcacacaaaaaattgattaaaatgtaattcacatgcaacataattcattttttgattttttaaaaattgaaatatactttatgaactgtaaatttcacctttttaaaatgtacagtttagtggtttttagcatgtttacaaccatcatttccatctaattctagaacattttattatcccaaaaagaatcccctactcattagcagtcatttcctgtatgcctctgccctcaagcctctgacaaccactaacatacttcctgtctctatggatctgcctatactggatattttatagaaatggaattatacaatatgtgactttttgtgtctgctttctttcacttagcctcatagttttaaggtccatccatgtatcaatatcaagatttgtgtccctttttatgacgaattaatatattattgtatggataaaccgctttttaaaattaactttttgtggtaaaatacaacataacatgtatccttttaacaagtttctgagagtacaatacagcacagtcgagtcgatgtataatgttgtacaggagatctctagaacttcatcttgcttaactgaaacgttgtggccattgattagtaactccccatttccaaccctgccctcatctcttggcaaccaccaaccaccattcaattttttgattctatgaagttgactattttaaatatcatctataagtagaattaggccatattttcttttgtgaatggctatttcagttagcatacatgaactaaaaagcttccgcacagcaaaggaaacaagcaacagagtaaaaaggcaacctagagaatggaagaaaatatttgcaagcaatatatctgacaaagatttcatctactatatatatatatatacacacacattgaagcactgctacaactcagcaaaaatactaataactcaactaaaaaattgggttaagaacttgaacagttatttctccaaagattacgtaaaataaccaacaagtatatgaaaacttgttcaataacaccaattatctgggaaatttaaatcaaaaccagaatgagaaaaaaaatagatgttgccaagaatgtgtagaaatcagagctcttgtatactattgatgggaatgcaaaatgttgcaatcacatggaaaactgtatgaagcttcctcaaaaaattaaatatagatgtactatatgatccagcaattccacttctgggtatttatccaaaagatttaaaatcaaaatttcaagaagacattaccactccggtattcactgcagcaatattcacagctgccaaaatttggtaacaccctaaatacccatcagtaaatgaatggatataaatgaaatatatccatacaatgaaatactattcagccttttaaaagaaggatatacttcaatgtgcgacaacatagaagaaccttgaggactttatcatgttacgaaatgtccatttactaccacccatacggtgaatataatatgtagtgaaagagaatacacacacacacacacacacaaacacacacacacacacacacgtgtatggagagaaagagtagaaattatttttgctcatctaactttgagcattttttccagaatttattgtattcaggaataagataggagtaaaattgaatggcagacctcagaattttgctacctgaagatttttttttttttttttgagacaaagtcttactctcttgcccaagctggagcgcagtggtgcgatctctgctcacgcaatctccacctcccgggttcaagtgattcgcctgtctcagcctcccgagtagctgggactacaggcacgagtcaccatacccggctaacttttgtatttttagtagagacagggtttcctatgttggccaggctggtcttgaactcctgacctcgtgatcctcctgcttcggcctcccaaagtgctgggattacaggcatgagtcacctggcccggccttaacatttttatctcaagcacctttaaaaaggagttttcacttctcaaatcctaccaacaatgtgctgaggacaaataaaataaggcttatctaagctgaaagagttttcactaatttaaaatatgataaatgaagactagacaagttaaagattgaatgagaaagagaaaagaagaaaaagagatgaaaaggagaaaaaggagaaggaacctgtgtggactgcagatcaaaaattctctcctgaccttatggctggattggcataccataccacgtttcttgggataaaaccaccttccaggcaattctgagccagctccctaggtctgagtacatatactgtgccctctgctgattcaggacgccagattccctgtgctataccacttggtcatattcctacccatactctatgctgttttattgccactggctcgactctagctctctttctcactgactgttatcctctggcctgtgttctgttttctcagagtcttctatccctttcatgatgaaaattagatcatattcatattctgtaactcccaaaaaagagaacggaagtaccatttcccttttttccccagataagatgagaacatggttaaataatgggatatcttttaaaaaaataataaaatctgaacttattcatttatttattggtagtgccttattgttacatcagtaactgcaacaacatgattttataggtaatgaaatttgatgccaaccttttagcttgatgcctctggccatatttgtataccatacaattttattcacgaacaaagtgattcctttttaaattttattttattagttctgagaaaggcttataaatcttaaaaaaattcctttcattaggatgacccatatttaaaataaaaacagcttttgttaagttttaaggtcataatctatttattctatctatctctattaagataagcattgtctactttttccttgattaattttttctttaatttttgataagacactttacatgagatctatcctcttaagagatctaaagtgcacaaatctgtattttaacctatggacataagactttacatgagatctctgggactaattcactttgaacaattacaattttatagatattgagtagtaactcactgttttcctctcctcccagctcctagtaatcaccattgcattctttgaatctagatgtccgacaattttagatacctcatatgagtagaattatgcagtatttgtccttctgtgactggcttatttcactcataataagatccttttcaaaatatctcgctgtaggaaaccatctactttacctgtacacgaacagggaaaactttaaacatttaaactttcctgaagtagggaaggtatgcctgtctactttaacccagaacagtcctgtgaccacagcagattttatttttacacccgcaaaatgatttaagtaccaaatctgaatcctacatggctcctaaacttcaaatgatggaaaccagttgcttaggaatgccagccagaatgtgatattcaaggaccttctctggctgttgcaatttacagccattttcactaccattaaagttgtatgcaaatcttagctctacaaacgttgacatcagttagaaaagcagacagcagaaaagtgacaaagaaaggtttagggctaattttgaaatagttccgtgacattggctcatgaataaaatgtaaatcaaattatatggtgagcacatacagatttaaaagcaagaaaccagagagttcaggaagaaaaataccttgtaagactccagaaaacaaaatgtaatgcaatttgcatcactggaaaaagacagtgggataactcatgttgcctccatcagagaaacctggtgagctatttaaactgcacatgactgcaccccattacagaacttcaaaaacaaaatctctgggggctggccttaagataacttttttagggaggcctagacgggcggatcacgaggtcaggagatcgagaccatcctggctaacatggtgaaaccccgtctctactaaaaatacaaaaaaaaaattagctgggcgtggtggcgggcgcctgtagtcccagctactcgggaggctgaggcaggagaatggcatgagcccaggaggcagagcttgcagtgagccgaggtcgcgccactgcactccaggctggggacagagtgagactcagtctccaaaaagaaaaaaaaaaaaaaaaaaaaaaaaagataactttttcaaaaaattatccaggtaaaatttatgtaacttaaactttggagagccttttgaaagtccatgatattcttttgtttctaactattttcaggaaacttctagagaaaaggtctgtgaaattgtgcaatttggggaacatgagtcaaagcattgtatgattttgaggatatttgtttaaaatactgactgtggcctgaaaactagaatgtcatgcacatgtaaacaaaacaatgataagagttggcttacaataaatcatagtaggaaagaatgaattcaataaattttaaaataagacggggaaatattcagtatcttgagttagtgatactgaacaaaatagtttatctctcagactattaaagctgcagtgggagaatatagaaaaaatacacagtaaattttggaagctccaacaatgttctttctgtaaaataaggataacaggatgttattgaagacatttaaatagatgccagaattgtttatcatgaaaaaatatgggtagcccatgtaccacaatgtcattacagtatgccaatacccctgggatgttagccaaaatggaggtaattttctgaaaacagctctgtcctgaacttaatccaaaaggcatctattcataacaaagtgctcccttcatgaagggaaaaggctatgccagatagaggagttttgttgatacattttcattataaaaataaacagcacatatcatgaaagaaattcattcatttgaaacaaattgtaaatatagccacacaaaattatttagaatatctgtaattatagaaatcatgttttttttgttttaataaagggaattttttaaataacagagaaataaaatagtaaaacaaggaagagcctgagacaccgacttctcctgaatttatgggtgagcttagttaaaattcaatccagcttctctgctttcataatcctatggcaatgttataacctgaatactgggcccaacaagaaaacgagattgattattcacatccagtttaaatctttctagtcctgagagaaatcactgtgaagaacaaaaatcacagagagtgggaaggaaataaccaggtcatgaatttttactttggtgaatttcatttggcagcaacattgaacatgagttaatattagtgctctgtttcaaagaattgaagacttaatctgtactactagaacattaaagcatttaaacattcactgatgatattgtattattaatccattcatccaagatattaatgaatgccttctaaggtccatagactatactaggtaataaagatagagtggaacatgtagtctagggaaagagtcaattatagaacagtatcacaagatatatccttatgtatatatgtaatattgcatgtgtgtaggtttgtatgtgtgcttttatatacaactatgtgtttttacatgtaattcattataaatatatgtatgcatatatatttcatatatatgcatttttcctcctccatctcatacaaaacctatttctaaaaggtggagattaagaaatatagaatacaataaaaatgaatctgagcacaggttgttaagtgaaggtatttcacacaatgagcaaaacatacacaaaggagtaaatgttgagaggttgtcacatgttcaggaaactgcaagcaatttgttatcatggtaaaaattaaggcttaggagatgaagttgggacgttgggaagatctcattaaacctatgaaatttgatgtttatctcagatatttgtatacattatgtcttagaaaagtataataatcgatatttaggatgggtttccaggtgattctaatgagcagctagatttcaaaaacacttgagagtaagaaaaactcaggcttagtcatgattgagagagagctggatctataattttctaaatgtgactctggatcggttggttgttccccctgaatctcattttcttcattctgaacatcgagatcttcatactatttgcctggcagagttgatttaagaaactgctaccatgtttgaaaagtaactgatactgtgcctgatggcagatggcacttagtaaatgacaatgttattattataagtactactcttactattcattataattaagagctgtcctcctagcaggagagaaaagaacaagtagccttcaggatagtaagtataagagaaggaaacccaaagctagaggagaaagtgaaggagcctcttattcttttattgggtaaagactttctggaaaaagtaacacctaaatttaatggaaagccagttaattcaattccgtggaagttgctctaccctcaggacattgctatacacataactatctgctggttgctatcaagcagtcagagctgcataattccatgactttagtcggatcaaaaaagaacctggccaggaatttaaaagtaaatcttgaggatctacaaggccatagagaactctgaaaagctctaacagagttctggtgatataaatggctgcaaacatttgtgaagccattccttggaaagacctgaaaaaggaaaaggcacctatcactcacctctgggggacactgagatcctgtacaagcagaatgtaaaaacgaaggctgtcttgtaaactgtctgaagtttaaagtcatgacttctttcataatccccatggcaaagtgtggaagacatacaggcaaaacaattaagaaaatctgactaatcagtggctgactaccatattataatgatccagaagttatgcataggaagtcaggattcaaaatgaaacctaaaaaacaaacaaacaaacaaacaaaacaaaacaaaacaaaaaaaactagcagaaagtgaagtgaccacatgctgcagagaatacagaatttacaggaataatccagaaaagtcactaaaataataagtaacaacaacaacgacaacaaaaaacacagtaatcacaaccacacaccttgggatagagggagaatgtgctaccagagttgttagaatacattatgtcaaatctttagttttcaacaacaacaaaattataagaaacacaaagaaaaatgaaagtatgccacaggaaaaaaaaagtaactatatgctttctacaagagacacgtttagttgaagactcatataagttgaaactagaaggatggaaatgtgaacaataaccaaagaagagtaagagtagctgtactaatatcagacaaaatagactccaagcaaaattattattagagtcaaaaaaacattttatattaataaaagaattaattcattaggaagataaaatagttacaatcatcttttcaagggatcatgagacatttcccagaacagacgtagagaaggttctaacacaggcctcaatcaatgtaacatgattgtcacaatacaaagcatatactctgcccacaggtgagtgaaagtagaaagcaacaaaaaggaatttcagaaatacacaaatacgtggacaccaaacaatacacacctaaatagccaatgaggaaagaagaaatcagaagagaaatagaaaatgctttgagacacatgtaaacaaaaggaaaatataccaaacttatgaaatgtagctcaggcagtgattagagggaaatttatagcttttcattaaaaaagaagaaagatctcaagttggtaacctaagcttccatctaaaggagttagaagaagaagagcaaattaacttaaagcagacagaagaaaagaaataatgaggtattaggaagtaaatttaaaaaatagagaaaatcaacaaaaacaaaagttgtttctttaaaaggattagaaaaattgcaaaaacctttaggctgaccaagaaaaaaagagagaggtctatattactaaaatcaggatggaaagaggaggcatcatttatttttatttttattttaatttttgagacagggtcttgctctgtcaggcaggctggcacgatctcagctcactgcaacctctacctcccaggctcaatagatctcctacctcagcctcctgagtagctgtgactacaagtgatagccaccactcatgactaattttttgtatttctgatagagagggggcttcacaatgttggccaggctggtcttgaactcctgagctcaaacaattcacccaccttgcctcccagagagctcagattataggtgtgaaccaccatgcccagctaaggcaacatcattattgactttacagaaataaaaagcatcataagagaatactatgaataattgtatgcaaatatatcagatcagttagaaaaacacaaaccctgaaactgacaaaaaatagaaaatctgaataaacatttaaaaattaaaaattaataattaataatcaaaaatatctaccataaagaaaagctgaggcccagatggcttcactgatacattctatcaaataaagcattaatataattatttccaaacactaccaaaaattagaagagagtaagcacttcccaactcatactatgaggccatcattaccttgattctgaaaccagacaagcacatcacaggaaatacacaaatgagtatcccttagagtgtataaacaaaatcttctaaagtattatccaacaatctgcagcaacatttaaaaagaattatacacatgaccaaatgggatttagccaagaaataaaagattggtttatcatataaaaatcagacactataggccgggtgcggtggttcacacctgtaatcccagcactttgggaggccgaggtgggcagatcacgaggtcaggagattgaaaccatcctggctaacattgtgaaaccccgtctccactaaaaatacaaaaaattagccgggtgtggtggcaggtgcctgtagtcccagctactcgggaggctgaagcaggagaatggcgtgaacccgggagatggagcttgcagtgagctgagatcgcgccaatgcactccagcctgggtgacagagcgagactgcgtctcaaaaacaaaaacaaaaacaaacaaaccctataatacatcttatactagtagaaagaacgacaaaatccacattatcaactcaaaaaattgtcataatttattgaatgttaataatgtcaggcactgctagacactttcaaaaacccacgaccacagttaagcctgccatatgtcttaagtgtccacggttcccatgaaattgcctttactgaaaacagacacagctttggtttacattctcaaaactgagaagagcaagagtagatctcgatctagggaaaactacagctagattctctaaaaatagtaataataatctgcctctgatcttgacctctatgtgttgactctgtcgtctctattgaggggacattatgcatgtagggatggcagagagcataacccacacacagcccagactccagtcctgacagcttccattctttaaatgaagtcctttatacttaagcattctaatacaaaaagacctggatagaaataagaaaagctaggagacactgtgtaattcagagaaagttgcttattttctttaacctcagcttacccatctctaaacagaaaacccatgaaaaacagaagaccacaggcatgctttgcctatatcattcggttgccataaattttagttttgaatgtaaataaatagatgtttgtgaaacaattgatgtttatgaaaactttctgtcagtgtgaaattcttcatgtattttgggtatccctttgtaaaaaatcatcaggtagggccgggcacggtggctcacgcctgtaataccagcagtttgggaggccgaggcaggcggatcacgagatcaggagctccagaccatcctggctaacatagtgaaaccccttctctactaaatatacgaaaaattagccgggcgttgtggcgcctgtagtcccagctactcgggaggctgaggcaggagaatggcgtgaacccgggaggcggagcttggagggagccaatctcatgccactgcactccagcctagtggcgacagcgcgagaccctgtccccccaaaaaaatcatcaggtaactagaaggagagttgctatttcatgtcataatttggaaatgttaggacttctctccagggaaaatttactgaaaaaatttttattgacctttttgtttataaaaattataactttccaatatagaatgagtggaaaaattgagacaaaatttaacaaaattgctttgcctgatgaagtaataagaatttttagagaaggaaatttggcatctgggctgaaggaaaatgagtacagagaaaatcctgaaagtagagtgtatcaacacagtagcaggctggattctagggggacagatggccatttgaaattctctatggtaggtaaattgtaatgatcttaggagcagtgatagctgacactagagtttaaatttctttgtgtcctgggctataattatatccattagtctcaaatattcgggaaacatctgtgaggcaaaacagctttgcattgttggttctttgttcaatgatttggtgaaaggattgtgttcatgttttgggacaggataatcataagcaatttgaatatcaagaattattgaaaataggattccataataatttaaataatcattagggttggagttcagagcaagacttcataggtgactaccagaaaaaaatgtaaggattctcatatccagagactatttgcaggaatatttgagatgatacgtttatgtgaaaatggaaaccaagaaatcaaggaagagacgacaccaaaagtttggatgcattagagactttcaaattacattaccaaaaaataattgcataagaccagaaccaaatattgtctacaaaatggaaattaacacaaaggtaagcgttaaaatttaaactgaaattcaaatggagtggcttgcttttattgccatgataactaaaattttttagaaagtcagggaaactatgaagccaatataagttgtttattaatatagaaaatattttcaaattagtaaccatttaatctgacatttttattgacaaaggcaggtatctacttactgtgagtcaaatgctgcaattgcatttatggtatatgttattcagccatttatatctaagtttctctttctttctttctttcttcctttctttcttttttgcacatctggtaggtaaatggcaaccaattttgctttgtggaagtttaaattgtggccatcttctctcatggccattattcctctgctaccctcagggggtatgatttgtcaagttttgttggtagaagtagagcccttccctgggtgtattcactcactgtcacaagcatatgaatgtttccatagtattcaggtcagcaataaggagataagtgaattggggaataattaagacgtgaaaatgaaagatgaaggaaatcaagtgtgattcagaatgattaattttggtgttttttattttttttaaatctgcaatatctgctgggaaaatgaagaaactggcattgacataccaagtttgagtcaggaggtttgtattcatttagtcttcaggaaatgtatgagtgataccataaatagccccattttagggagaaatctactgagtttcagagagatttggttccctgtgggagttatgtaacaaattaaagaaaaacatagtgttcagacttctatctgtgaacccagaaaatccgagacacgtctcggttaacttagaaagttcattttgctgaggttgaggatgtgcctgtgacacaacctcagggagttctgatgacacgtacccaagtggtcagggcacagcttggttttacacattttagggagacatgaaacatcaatcaatcagtgtgggtaagaagtacattggttcagtctggaaaggcaggacaacttgaagcaaaggcagaaagactgaaagcacgtggggaggagcttccaggtcacacatagttgagtcacaaagggttgcattgttttgagtttctgattagtctttccaaaggaggcaatcagatagacaactgtctcagtaagcagagggataactttaaatagaatgggagccaggtttcctctgagcaatttccagcttgagttttccttagtgattttgggggcccaagatagttttcttccaatcgaatcttaaaatctgtatcaattcttaaagagcttaaaatcagcccccaactcttgcccttctgagaagacaaacataagacagctatactgcatgcaatcaatttaatgtaatgattgcaaacatattttgaaagagtagaaaataaaccaatgtaatttgaaagacactttgagaagcaaaattatttttgttgtattttatgtgttatatgagggggcaggcaaaaaggaattctatcttcttttaaaagaatcaagcactcatctaatgtatatatgtatttgattattggtgacaaagtacagcaacacaattccaaaaaacatttaaaatttgataatagagcgttctaaaagctaaaatgcatagacaacttttatatatatcatgtcattatttttatgtataagtcataaacagaatactctcctttccaaaaaatttaatatagggagaaaaacctgtgttctttactattataaggaatcatctttatgtctacagtgtttcttccaggccattgtgaaatttcattgagcaattattctgagacagacatatttccaagaatattatattatttaaccttaaataattttgccattgtttgtaccttgccttcatatggggaaaaaggagttttactccattaggtacacttctaaatgatgttccagaaatacaccaaacaagcaaattatttgcatggattggtccagttgagaaaatatgctgctcctgcagcctccttgtcttctcttagctcccacactggaagatggtgaaagatcccagtgctgcttatagactcctcagaggaagtctttgcaaatgtagagggcacttttcccaactctctctagcatctagaaatgtcatgcttacctctgataattatgacatatgaaccagtaaagatttttttttgcacttaaatataccccagactttctcttgttggttttattgattaattaatttagaaaacctcaacataaaatattttacctatgattcctggattttattaacaaaatcactagaaaaattttaaaaaatgtatcaagatttccatagttcaaataatttttaggtattaagtacctaatggccatttttttttccaagttagtgcatttgagtaatgggtgtgtgtgcatgtgtgtgtacatatccatgcacattctaatgtctctagcatgaatttctatgtcatactatttataactggaacttggctggcatttaggaaaccgttgatttacttttgcatgtcaagtatggaaatacagcttttccctcacacaatgactaatgagcctgtcagcagaatggtgttttacaggattttatgtaacaaaggactagtggctactttttattttgtactcagagcaaccgaaagcagcaaacagaaccaaaatgtcaagtgtaatctgtcatgactcaattacatctgaccggaaacagaaaaggaaagaaatgtattattagataaatctaaaagagccattagataatgaaaagattttatttctcatatgcattatttgtcatcaataaacaaatatatctagtcaatttccctaaaccgtaattatgatacatataaatactataatattctccatctgctcgtctttgattgtggtaagcaggtagaatatctttaaatctgtcactaattccttccaatcagatagcaacaggaaagattagtcaacactcattacaggaaacatctaagatgtgtagcttcaacatcatttgtcaataaaatgtgaagaatcaaaatcattacaatttcctagagtcagtagtagcaatttcagataaaaaaaaaatcatctatgcagacatctgagaagaaattgaacgtacaaatctcagtggatattttcatgttgagttggaatccaagcatcataaaatatcccactaggacatgttggactgtaatatttccaaagctgaaacagaatccaatcaagcaagagtgtgcttatggaaggttttgacaagatttcttccaagggcaacccccagcatgaaatagaagttttctcacagcaagattcatctgtgatgcacttttaacattgaggcagtcacttgtcaagtactgcagaattggtggaggcttctgaggactagatctgtattctgcaatagccacacatggctatttaagtgtaattttaaattaactaaaatgaaataaaaatataaaatgtagttcctcagtcatactaaccacttcagttcatttttctctctaaggatccaaaacggtgaatacctgaaggtaaaaactacacagaggctgggcgtggtggctcacgcctgtaatcccagcactttcgggggccgagagcggcggatcatgaggtcagcagatggagaacatcttcgccaacatggcgaaactccttctctactagaaacacaaaaattagctaggcgtggtggtgcatgcctgtagagccagctactcaggaggctgaggcaggagaatcgcttgaacccgggagatggaggttggagtgagccgagatcatgccactgcactctagtcttggtgacagagtgagacccatctcaaaacaaaaaacaaaaaacaaacaaaaaaaactacacagaatgttggaattatttaatgtaatgtatatgtttttataaactttccttcttcttgataaagcatggtatgaatctgacctcaaatatagatcctaaacccttgtattccattacttttacttttttttttcttttttgagactaagtctcgctcttgtccccaggctggagtgcagtggcgtgatttcggctcactgcaaacatgcttcccgggttcaagtgattctcctgcctcacctccccgagtagctgggattacaggcacgcaccaccacacccagctaatttttgtatttttagtagagacggggtttcatcatgttggccaggctggtctcaaactcctaacctcaggtgatctgcttaccttggcctcccaaagtgttgggattacaggcgtgagccaccgtgcccagcctaattttacttattaatcattttataagctaaacttattttcctcaactggccagccttctggctggttcatagagcttctttcctacttcatttttcttctcttgctccacattggtcacactagtcttcctattctcttcaaatactcaaagtacattctaagtactagctaatttctctcttagtgcctagaaatgctatttccacagaaacgtgacccacaccttgaaacattccaacttctgtataattattattttctgataactttgctgactttagaatcttaagatatccttgtagtgctttgaattttttcttcaaagctgaaataatattatacatttatgtaatcaccatcatcaccattatcaccaccatcatatcactaacacatattgggtatttattatgtctcaaagatggattcaagaactttacctatattaaaacatccttatataggcttattatgttatgtcttttttccatattgtacagataactaaaacatggatgagaaaggatagatatctgtccttcactcaactatagtggtgcctgggtttgaatgctggcagtctggcaggtccatgataccagttactatttttgtttaattggctatctccactttcacgagaaaaggatatctattttaagcaatactgttatctctgacacctagatcaccatttatcacatagagtccacttaataaacacttgctaaattagtgaaagaacaaaataatcaatcgattgatttttaaaaatattataaatataaaaattaaacaataaagttccctggttttcaatgtgcccatatctttcttacttttaatttttttccttttaattaacagaaggactccactgagatcaaaatgtgagacaaagttcaataactgtcagtgttttatccaaacttccagctcttttgtctagagaagtttcacaactcctttctggcaaaaggttgtgagtaagctgtatctgttgtgctctctaaggttaatgtccataggaagattctatcatgcaaaggcacaaaaagatttcacatcaggagaacattatagaacagagagcttagtgagtatcaggtttcgtggcacgtaatttaagaatttatgagaaagatagtgttgcactcagatgggctaagtaacaaataaccccaaagcttagtaattggaaatgacagagtttatatgttgctcttgctattagtccatcaaggactctggaggatgttatgtgtccataatgttcctgttacactcttcatcaagggctcacctcagcactcagggactgcgccagggtaccggagcggcccccgtgtctcatgttatcagttgacatgacagagagaaaactgagagttctacaaggtttaccaccaacaactggagacatgacctagaagggacacacatgactaacactcatgacttatccaaagctagtcacttggccctacacacccacaagagtgctagaagctgtgattctgtaagtgtccagagggcagaccttcagaaatatttctgaagttcactactgcctatcacagagagaaagaaaacgcaaagattgaatatgtaggctgggcattctaagaaaagtacaagcccagtattccacaagggaggtgtagttacaggggatcctggggagaaacattactaacaagccatcaaaaaagacacatctgatatttgtttcatttggaaagttctgtgtttacaaccataaagaaaagttcatgttcgatagcatgattcaatagacacatttgataaaaagacaccctcaccgtatctctcttacagaatcataaaagggggcttgaggtttcatttattcagactgagtgttgtcgtgtgtgtcataatttcagagactgtattcagtccatgatttccagtgatggaaatgttctaactacgattcctagtttcttctgtgttcctaacacctaacctaaatcacatgggttaattcaatttcctcctgttccacagccaaaagaaatgcagaactgctagttcccataatcactcttcatatgctttaagaataattctacctataatcccagctactcaggagtctgaggcaggagaattgcttaaacccgggacatgcaggttgcagtgagccaagatcgcgccactgcacttcagcctgggcaacagagcaagactccatcagaaaaaaaaaaaaaggaataattttaaaaaatacctccatctactcacccccatcctcagccagcaactaaatcatttttttgtactacatgttcaaatcttgtttaccagatgattagccattttaatatatcttctctggattttttccaggttcttttcatctttcaggaaatatgaattctgcacctgcatttgaggcacgatgactcaataatttcatggtggcaaaaactaaataacagtgtcctcgttaatatcacctcgactcataatagttctagcaatatcttttagcactcatgtttgtatcagacagtcttctgaataccaacatctttttttgccatgttttaatttttttttaaacctctcttgttcttattatcctctacaattacaggctgaaagagaattttctgggtctaaggaaacttctgttctccctcccttaacactctataaaaccaccatcattctttccttaatcttccttgcacagtattcgccattcagttcaaccttcactaacatctcagtgagggtaaaggtgaacttagtaaaagactgggatgtctaaataaacatgaggggcaaaaaaaaaaaaaaaaaaaaaaaaaaaaaaaacagaacagaagtagcattcgttggttaaagcaaatacatgctaatctgctgaggcaatttttgtccttgctttttttttttcttctgagacggagtctcaatctgtcacccaggctggagggcagtggcgtgatctctgttcactgcaacctccacttccaaggttcaagcaattctcctgcctcagcctcctgagtagctgggattacaggcacaggccactacgcctggctaatttttgtatttttagtagagactgggtttcaccatgttggtcaggctggtctcaaactcctgacctcgtgatccaccggcctcggccttccaaagtactgggattacaggcgtgaaccaccgcacccagcccgcccttgctttttaatcattaaacccttgctctaattctgtttgcattactgacttttaaaaattaccaaagcaattatattctataattccttcatttaagtgttttacatattttgatcacactgttttagattcctggaaaggaaacccactcgaaccagtaactttgaaagaggcatattgcagaatccaggcctcacaagaatccaggcaaaactctccaagcacaaggaattggcagttccagggcactctttcatccatctctttctttcttctctccattggtgactcatccctcatgcttattgctgtaacttttctatccttacaaagtatatgggttttatgttgctgccattgctattgtgtttgtttcttggtaagttatctcgcagattatttagaataaccatcccaacctcaaaatttaagtatcccaggcctatctcttaatgttactgcaaaagttttgcaactcgtttgtcagattatgttgatcaggcttattttttaataagcccagccacatagcatacatatttcctgatttggtataacacgtgtagacctgatccaattatctattgctattgtgtagagaaaaatagaatatgtgaatcataaaatgttcattttatggatttgccttgatgggtaaatgcaaatagatcttagacaaataaattgtattaacatgcaagtgtataagatgtctggtgatatgaaaagagaaacaataaaatatagacaatgattgcctaaaataatattagtcttacttttatcttaatcaagataattgtaatttcctggatctctgtgtataaaaacaataaaactggtgggtgataataataattttatacctggaaagcaagacatatctaggaggaactgagaagtttaaaagtcttagccagtattcacactggcatgctcatatgacctgaaagaaagtgctttgcagcaggtaattcaaaggcaatgctacagattgtgtataatgtcctagaatttagagtcgcaataaaaaaatcagcctaactaacctcaaactcaactatcaattctgagtgaaacactgtcaaatgcctagtgacctaatgtgattagtagtccttccggacggcttggttttagggtttctgattagcacaaaatatcacaagaggcagcttgtgataaaagactcattggtcttttaaaacttttatttatatgatattaaacacaattttttaaatcaaaatccaatagtctgtaaacaaacaacagaggagctattcttgcatatttatgtaatgccttctatgacacatacatggtggttgtttgattgtataaaaacagaaatcactctaatattttatattatagtatttgaaagaccatcttagtgatgaatgaaactgcatgtaacaggcagtcagtaaaaatatgtagtgaaaataaacattgataatataattttgacttaccttctccataaacattaaagactcaattatgattctgcagtaactactatctcaacaatgtacaaagtctgtcacaaagccacaattatgccatgaacatttatgccttaatgttgaattcaaaacagttacactaaccttattaaaacaaaaaagcatgctaatatttctcttactataataataaaaaaggtgacttgtcataacaagattaatattgtaccaaggataataataatgtgtgtgaactcttctaacacatatataaaattcacacctagtctatgtaattattaagtgctatttgctctaattattattgtttttcattcatattcctgagtttctctttagtattttgtttacatttgaattttcaaattaaattgtgtttataataaatggataccaatctaacactataaagttaaagactttgacacattatattccattatctggttttggaaaaaaaggttatatatatgtatatttcaagtatgtatatatgtatattatatatgtttatatatgtgtgtgtgtatgtatgtgtgtatttctaaagaaactatttggaaaacctacatcatatttgtttttccattttaaaaatattttactttgaaaggttgacttcttttgatgatcctttatgacagccttttattactttccagaatttacagcttgtctcacactgctcactagaagctgaactttcagtaatgccagttcactcttatttgaaatgttggtagttgtgatccttgtttgtcaaaatactgttttaaaatatgacagtcattatatcatccacatttcttaagtctgttggtggctttgatttaaagactagattatttgtttgaccagtgatttgtgagcaaattgaattcaagttcatatacacagaaagccttgtggcactaaatcattatcaggagacttttccatttgatgtatgtactcaaaattagatgaagataattttctgcaacttaaacgtggaactcaaaaattcctgtcaagataaaatggaaacttatcatccatttgcttgtatatttttaagaagaacaaggcaattaatttagacattttcttcctcaaattacaatgaaggtctgatgcaagactaaactgcatcctagaatcagcaatgttattacctttagagacgatatctttgaacatagagctttatggacgtcaacaattctgggaaaacgtacatttaaacacatgtctttgattttaaaaagtattatgcagtagctacaaaataatatttcctaaacgcacagtattaaagtatcatgctatggcagtagtttgacaactctatatgtcaattgatgtccccaaatatgtgcatggccatgtatcttgtttgtctttgttcaaaaaatttccataaaattgctcttatttctcgttctctagaacgtgtgttgaaatatgaatgtactgtacttgcacatgttgcttgatgcattttcaaaatattatctctcagagaattgagtgaaatattctaacacaacaagatttgttggtatttttattcactgagacaagaaatacaaaccgtctgaggaagactcattttagcctttactaaatcaccgccacagtgttgaacatcggtgaaaatggtttaacctgcctctcatgtgctggtttcctgtgatgttcagctcccatcacctgtgacctgataagatctcatcggcagtccataatctccggcttgggcaagacttttaatctgtgcagcgcatagtaacttctccacctacaggcctgacatgtttcactacggcagcatgaaaatcagtttatttatgttgaatgcatgacatctgacagcacttccccactatataagtgcctaacagtttatcaaatgtcacgtttgaagttatgtcaataatccctgtctgtgcctgatgcttctgcaactgtgaatgacctgatcttttaaaatatcatcttgcatactgctattagacagtagtacttttagctttttacttttaaataaaaatctatgcctcttgactacagctgcctatcctttggaaatgatattttttcaattactgtagtaattctcagtataaaatatacatctagagaatacacagagtttgttggattaaatatgagttttaattcttcacattttaaaaaatccctcagacatctggtttagcaagatctaagaaaaaaaaacattttgctgtctatcatttgccatctttgtgattctgcagagtttaaaatttagtttgattgcattggacttttttatcactgaacttcttattcaaaaagaaaaaagaaaaataaagaattagagaagggacatgtagcaaagaacgaaatgaaaggaaaggcttatttattattgtctttatgtgatattactcaaattggctagatttgtctttgacacagagcaataaaactgtgatggtagttcagcacagctacaaacgccagcttcaattcctgagtgacaattctccaacccaaaaggaaaatggagaatacaagagtgattccagtaggttatgcgacatgtcaactgtaataggacataagagagcaataactcagtgatgctctgaatgactcacttactcttcttggtactgatacctagctctgatcaaatggtatttattacggatgttatgattagatggaattgcttaaatgggaacactctcaccagaaatgaatacgaatagagaaaccagccatgaaatacttgttacatatttttacatcatttatttggattccaagtacaagagttcctctttgaagcagcattaccttaagccaaagcagatttctagaggggtctcctccctttccaggaaatttggcttactgtggttgagagagcccgtgggcccaaggttctgcttgtggtaacaggcaagggtagttgtgcattctggctgatggtaatgactgaaatgtcaccatgcataaagtaaagaccttgtactgccaagaagatctgatgtaaagaatgataccaaagagagtgatgccttagtgtcatctgttactcagaataacacatgaagatatctgtgccataaaacaaacttgtgtaaatatgcacttcagccacagtgaaagaaaaccatagtcccatatattaagcttgctcactctgacatgatagctctggattggctttgttgcctcagcaattcctggctagtagagaggtatctgactgaccaggaaaattgatccagggagggctatactgttgctcccttgtctctggaggcagccatggtcatcctatggtgacatgaaggtttggcatgctattagtctcctctttgttctctttcagtttctcaagggcctatgactctttaaagtggtagacaatgttcgattataacagccagttgagatttgagaacaatcgcacgttctttagtataattatgtgtactcatattgccatttagtaccgcagtgatgttcaccagctctagctgtgcttaactctgagaggtttacctggccatcactttccctacataccctacacacctctgttccaaccccgtgaagtttgtccaaaaaagtagatatatttccctgatttatctggatgtgtcaactgggatagtcatttcaccttgccttttccccagagcttttttctaaagcaaaatagtgaaaaaggtagaactaacctggagtgagggctgttgaaacaactcgactcatgcctaccagttttcgacttagccatatacttgcttagtggacctataccattcccgccatggtagaatatttcagaccccgacgaattccaggtgtgaaataagagaaaacttgttagtatacatgtccaaggattattttgtcatataaatgtattatttatcttctcaccataaacttcccttaaaaatagagaggaacagtattaagtgttgaagacagcatgtattttgttgtaaagcttttctcttctctactttttttttttccaattctgtttctacagggattttatcatatatttttactcaccttttaaaacaaatgcagtgaatctctgttattcatgaacaacctaatagatgatttaatctaacatttgataccactggatcctggtccttaagaaacattccagctttctctacccaaactccgtctttcttgcagtcgctcccagaagtctgaagaagctgttaaactcagaacatcagggaatggggccaatttggtattctaagcaaattaagttatatctgtcacacatttattttgtaacgacttctccactgcactgcctttcctctcaatctgtactatactctatgctctcctctactttataacttgtattttccccccaagcaaaaagctcatttcctaccttctctttctatttaagattcttgaaaggatcatgttatgttcagtatctccacttcccattttcacatttcctattttctcaacccagggtaacctggttgtcaaccccaccatattaattacattaaagtcactaacattatcctaaattcttattttttttagtctcgccaccacaaactacttcttaaaatgtacttagtggacatccatttttttctcaatcctcttaccctgatctttcatcccatcaattaaatcctgaagagccctgttattacattttacctatttctccttttttatgttattctttggttatctaattttccctaaaatatgcatttttttcattattttcctaccaaatttgaaaatgaagaggactttctgtgccacaaaccaggcttgaaacctgggaaccattcttgataattttccctctgttattcaaaattaatcaatcctgtgttcatatttatcttactttctaaatatcacatgtatacttcttcttgccgcacaatagtaactcctttagtacagagatttattatttctcactctctattctattgttatagcctcctaattagtattccaagttcctatagtgtttttcctcaaaccattgtctacataaaaactatgtttttgtgacctcaacagcactgtagcaatactcaaattgtgctttaaaaatatcttgctttgcatcagaatgacataaagtgtattttaataaagcagacagttcggccccagttaaaaatctctggaggaggggcatactgagaatttggattttaaaaaatgcacactacagattgatacctaagtaatgttattactttctccactttaaggcaattgtcctatagagtgatacatcctccatgatctgtacactctgttcattgaactgtagagaaagtaaaatattagaatattaattcatattgatattttatgtataagaatgacaatataggctgggcgtggtggctcatgtctgtaataccagcacgttgggaggctgaagcaggtggatcatgagatcaggagttcgagaacagcctgaccaacatggtgaaaccccatctttactaaaaatacaaaaattagcctagcttggtggtgcacacctgtaatcccaactactcaggaggctgaggcaggagaatcacttgaacctgggaggcggaggttgcagtgagctgagatggcaccactgcactccagcctggacaacagagtgagactctgtctcaaaataaataaataaataaataaataaataaataaataaataatgaccatataaatatgtattgatatttaacccaataatcaaaacaaacatctacacttggcttatttcagatggggacatatcatagataacacgggtagtggtactctcactctaaatttccttagcagatttcaatagatcaataaagaagataagtgggccgggtgtggtggctcatgcctgtaatcccagcgctttggaaagctgaggagagtggatcacctgaagccaggaggtggagactagcctgagcaacatggtgaaatcctgtctctactaaaaatacaaaaattagccagacatggtggtgggcacctgtaatcctagctatgcgggaggttgagacaggagaatcgcttgagccagggaggtggtgggaggttatagtgagcctagatcatgccattgcactccagcctgggcaataagagcaaaactccatccccccgctgccccccccccaaaaaagatatatgaattgcattttcaaatttagcccaactatttcatcataaaatagtaaaatagtcaaatgacctaataatcttgattacacaagaatgacaaattaaagatcaataatgtgagtgcaattggatgtaaattgttttaaaattagttatttctcaacatattataacataaagataataccaatataagaagacctgaaagaaagcctgccaaaatattaaatattacaaaaaaaatttctctttaaatgtagatttaaatatttttcattgttggccaggcgcggtggctcacgcctgtaatcccagcactttgggaggccgaggtgggtggatcacgaggtcaggagatcgagaccatcctggctaacacggtgaaaccccgtttctactaaaaatacagaaaaaaaattagctgggcacggtggtgggcacctgtggtcccagctactcgggaggctgaggcaggagaatggcgtgaccccgggagacggagcttgcagtgagcagagatatatcgccattgcactccagcctggggacagagcgagactccgtctcaaaaaaaaatttcttttcattgttaagggtgaacattgttaagtgcacacataccattccttaaggtctaagttaatgttgatatgaagggatcatgctgtgcatgcccattataaaccaaatgtctaaaacacaaaaacattttagaatacaaaatgttttgtaaagaaatatattacataatagatttatctaaatatcccatttgtctttatatttttattctaagttgttaatcccttttgaaataaacaccatcttcaccttgtattagcagagccatacatgcagttattaataaataatagagcggtactgggtgtgtgtgttcaaagttttattgatattaacatgtattgaaaatatttgcagaccattgctttagttttgtgacattaaaaaccctcttagtttgatttcttaaattgaactaacctcaatttacttttgatgacaaagttaacttattataaatactttttgatccactttcttatagagattgagtcaggcatgagttcttttgaattttaatttaaagatgtcaacaatatcatcactttctaaatcaaggtgctccatttttaattaacaatattaaaaaactttatttttttttctggttaccataaattctcaaatgagaggaataatgttaaaaactttataaaggcctacacctccagttcattgagattcaggacaattcactctttgattaagtatagataagcctgacacctatgtaggatcacattaattatcatctaacaggagaagtcacttttactaaactgaagtttgcgtgataccatcagcctatgttaaatgacattaaaagaaacatgtgattctggtgactccagggatatttttgagaatattttccactgctattcacagtctattctgctaaggtccacaggcaacatttctctccggtatcagtattaggaatagtggtgtttgttttgaaacaccttccttacacttccttacagtttgttttgaaacactactatttgtttcgaaacatcatcagttgaattaatttcattcaattcagatatactttttattacatatggttcccaacttacaatggttctatctaaacaattttttgactttctgctgatgtgaaagtgattcatattcagtagaagcagacatcaagttttcatacaacctttctgtttttcacctttagaacagtagtcaatgaattacatgagaccctcaacactttattataaaataggctttgtgttacatgattttacccaactatgtgcgaatataagttttctgagcacatttgaggtacactaggctaagctgtgatggtgagtaggttagacgtattaattgcattttcaatttctgattgatttatcaagacaaccctatcttaagttgaggagcaactgaatatagttgcgaatataaaaagacaagacaaatagttacaatgtcatccagagaaaaacaataaaatgaaattagtaataacaaatagttgtatgtgattaaaaaaaaaggaatagaatacaggagaagatttttgtttcttgcttttaattgttgaggtaggtctagttacaaatggatacaggaaaaggctttctgaaagttgacaataagtatacaaacgacccaagtttccgcaggggaaaaaagttgacaataagcagagaaacagaactaacgattttatttttttaaaaaaatcttaaattatgaagaaatgtatttctgacagagagaataacataagagaaggcccttctctggaattaagatgattgaagggatgtaatttgtattttaagcattaaaagagaaagagagtagttgaatctaaatttgagtaaattagcagaaactagaatgcaatggatttgtagttttttcctcataggtaatatttatttgcagttcagtgtaaagctattgaagacttctaagcagaaactaccataatatttaatttattgttatagcaatatgttccattatagggaaaataatggaagaaaatatatacttgccatagaaaaaacagtaaacaagttactatagtaatctgatatttatttctgcataaaaaatcactacaaacttatatgattaaactattattttgcagttttcatgagtccagtcctgctatgccttacaggtgatatctgcacagggtctcacaagtgaaaactaaagtgagaactgaaagtaaaatcctatgccctccaacagaccaaatgtagcccttcatggacaagggtataccagagaaagtttaaaaactgagctcccagccacgactagatggaaggtctatgatgccttgttataccctcgtccttttgcagttgaggcacaagtgagcatcattaatgttagaatagagatcataagactgacagaacagacgctttatgaaagtaaaattccaaattatgaataagagctaaagccatgccaggcaagggttaagtcacgcacccctacactccaagaataaaccatattctgactgccacaaggtttctctttttctctagcatctaaacaagtactggcccggagagaagctatcttaaaacaattgcagctcacccacggccaggcctgttgactaactgaccacttctcttggccctgcctgagttcaaaatgtcataactacaactttgatttaacaagaggctgatttcagtaactgtctcctgagaagagacttccagccacggaatgattctggctgaagaatcatgcatgttacatacaacccatgttcattttggggtgaacacttaacatttaaatgtattaccgtttatttacagttccctatactttatgaagcagttacacacgtgaaggcatggaaggcacatggaggcactgaatgctttcatggtaatgggaactgtaaggaaactgtaatacatttaatgttaagtctccaacccaaagcggacatggcttgtatgtaacatgcacatttattcagtacacatgtgttaggacccccttcacaaatattcacagctcctcctataacctgttaaatatgtatacttggccaacccattcagcataaatccctgttccaccctccctaccttccacatgcctgcctttgtgtttcagccagaggctgtgcttcccaacctgtcagaatggcccccttggccggatgaggtggctcatgcttgtaatcccagcaatttgggaggctgagggaggcgaatcacctgaggtgaggagtttaagaccagcctggccaacatggtgaaaccccgtctctactaaaaatataaaaattagctgggcgtggtggcaggcacctgtagtcccagctactcaggaggctgaggcacgagaatggcttgaacccgggaggcagaggttgcagtgagccaagatggcaccactgcactccagcctggcggggatagagtaagactccatctcaaaaaaaaaaaaaaagaatggccccctggtaggctgtcatcttttataaggaataattctcttcttaaaatttatgaagatatccaagttttttgttaacacagatagaaataaagctggcagccatggctgaggtcttatctgaggcttggggtattctcccaatctcatatattttttagcataattagttgttttatttttgaagctgtagaagttagggcagttttaattttcaaagacatcatgtattgtaggagttagggcagtttcctttttcaaagacaacatgaaagagaggcactgacttctagaacctcttttatgagcccaactgatttgtccaagcctacccaaaataatcatctttagataaactcaaagtaaactgaaaagggccttaattccatctgcaaaatcccttcaccttttccatataatagaacctaactttggaaatgatttcccatcatagtcaacggttcgacccacattcaggaggaagtgattatacaaggcatgtacatcagggagctcaactctgggggaagtctgagaattctacctattactatccacctgcaatttacttctttcccacatgcaaactatgtttactctctcccaagactctcaaaagttgcatatcattatagcaatggctcaatttccagaatctcatcatctaaatctacatctcatcaactcaaagtttaaaatgccatcatctaaatgagatgtgaatgagtcccctaggagtaatcatactgtatcatctgtatttatacagatcctggggcagggcatttctctctctctctccccaccagccccccattaaggagacaaattattggcttttaacactccaaacaatgaagagaaaggcaagggatagcaggtgtagattgtagatatttgtgttagtctgtttgcattgctatgaaagaatacctgaggctcaatagtttataaggaaaagagatttatttagcccatggttctgcacactgcatatgaagcatggctccagtatctgcttctggtgagggcttcagaaagcttccaatcatgggggaaggacagagggggttggtatgttacattgtgagagaggaaatgagagagggaggggtgacgccatgctcttttaaacaagcatctctcacagggactcataggctgagaactcactcattactgtggggagggcaccacaccattcatgaggagtctgccctcatgacataaacacctctccctaggccccaccttctacactggggatcacatctcaacatgagatatggaggggacaaatatctgaactatatcaatattccatttcagaaggagagtaaataaaaagtaaaaaggagtcactggccatcatagtctgaaacacagtagacaagcgcagcatttcccttaattaggtttcaaagcctgggaataactctcactgactcttggccaagttgtgtgggctcttgtttctgtcttctgagttgtccttcctttttcatggagggtagtatacgtttgccactgagtagttttaatagccttcttcctgccagtagaatttctgagggcccataacctcctaccattttgtactctctcagtccatttcaatcacagctggcagtgtttctgctgaaatgaatttttcaaaatatttgtgggtcttgtggggatttcatagaattttcctccattagacaaaagccacattcacagatctttcttgagataatcctgtctctatcttaggcttctgctgaagtggctgaggggacaataccctcaagctttctaaaggccttctggtttaagtaaaaagaaatatgaggcatgttcccactctcttgaaaaggtcctttctgtggctgactactttgatcttttgatcaatctgaaattttaacgaaaggttgtagtcatacattcagtctttctctatactagttttggcagatatttctgatacttaacatttttgtcatctggagaggcagagaacttacaaaattatctagcctgattcctttttgtttaacagttcttcctttaatttatctctttcctctcctattttgctataaacagcaagaagacaggggtacatactttaacattttactcagaaatctccctagctatggccaggttctttctttacaaattctgctttctgtataactgcaggtcacaatttcactaagctttctgccactacttaacaagtaacttccttcctctggtttccaataacatgttcctcacttccttctgagcctgcactggggtaacatctttagagtgcagattatcactagcagtctgatgaagatttaggccttatctcagtgatttagactttctctactatgctcctcagaatttttctccactcacttctcagttccaaaacttccccacccttttatatctccattgtacctgcagcccactttccagtaccaaaacctgattaacataatgccataaattcaacagcttaaaacagtatacagttgacccttgaacaatgccaacttgaactgtgttgattgactgatgtagattttttcgataaatatattggaaaactttgtgcagacttgcgacaagatgaaaaactcacagatgaaccttgtagcctaaaactattgaaataattaagaaaaagttagttatgttataaatacatgaaatatgtagatccttgtctatcctagtctattttatcacttaccactgtagaatatgcaaaaatctattgtacaaggttaaacttcatcaaaacttacacccaaaaatacttacagactatacacagtgccattcccagccaagagaaatgtaaacaaatataaggaggcagaattaaattatcactgcacataattaactctactatatactaccataataatttcaaagccacctcctgttgctgttgtggtgaacttaagtgttgcaagcatccgctaaaaatgctgtgtgacgttcatcatctctgcaagagcagttcgtctctccagtaaattgcatatggcagtaaaaagtgatttcttaaggttcctatgtatttttcattgtgttcagagcactactgtaaaccttgaataacaccatgagatgcatatgaagggccacttgtgatgttggaagtgctcctaaaaagcagatgagaggcataaccttagaagaaaaagttaaattgcttgatatctaccatagattgaggtctgcagctgcgggtgccgccatttcatatggaccattcattgtgtaaacaggcagtctaaacttaaatcattcacaagtacagtcgagtgctataaatgtattttctctttcttatgattttcttaaaaacattttcttttttagcttactaaattgtgaaaatatagtatataatacatataaaacaaaaaatacttgttaattgactatgttatcttaaggcatctggacaatgataggctattaattgttaagtttccagagagtcaaaaattattcctaaatgttcagctgcacaggtggttagcatcctaacccctgtgttgctcaagagtcaactgtatgtttattatctcccaatattcatggattaggacactgaacacagcttaattgtgttgtctgttcaagatcatatgtgtacagccaaggtgttgatctcatctgaaacttaaggtccttttcctagctcactggttgcaggcaaaattgagttcttcatgtttgtaggactgaggacttcagctcctagaagttgtccatcaatctctgtcacatcgccgacttcataccatggtggtttacatcttcaagactgaggagagcttctttcctacttctagagactcttttaaagggcccatatgattaaatcagatccaccgaggaaactctgccttttgattaacttaaaatcagttaatcagggtctttaattatatctacaaaattcttttagcattgaattatgatgtaatctaatagtggtaatgataacccatcacacatagatatagatttagatattgattagatatagatatatacacacatatgtgtgtatatgtgtgtacatatataatgcatatatgtgtatatatatacaatatattacatatatatacgtttgtgtgtgtgaatgtcatggccacatcaaagagaaggctgttataagctgtgaatactccatgcttttacttcagttgtgatatcattatacatatcaaaatctggggcttgtataagtggtgagactcttggggatgatcttaaaattctgcctaccacacaagttatagagttggtaccattaactaaaataatggcaaaaataggaagataagtatattttcaaatgatatattttggagatagacatgacagaattcactgtatggatgggacatgagatgtgaaagagaaagaaaaatcaaagataatgactgggtaacactaccacacacatcacttggattataacatggtaactaaaattaaaaagtctaaatttctttatagcttatagatgcaattaaattattttaaatagatgagtgtacatttttacacaaagtgacagaacacttgaaacaaatgttttatttgctatctggaaagcaggtatgccatcctaacatgcattgttttcttttttgtggttgaaataccaccactccattgcattttcacgcccttattttttgctgttattctggatttctctaaattttaatattattttaatagtacctatctcttttcatgtaattcatccatgtaggataactttacgtttagatcaaagcagtatataaatgaatatatatacacatgcccatataaacatttaagcatgtctttgaatgtttttatagtctgcacttcctcgcctcaccccttcattttccaaaatcatttattacactataataattctgagctccagtcatataaaaacacaaacagctcacaagcccaccatgaaattttggttcttgtgctttattacataatatttcttctgcctgtaaaatgtttgctcccttctcccatcttgaaaatttctcttcattattcaggacataggtcaattactacgttttagcagagattagcttggtcacaaccaactgggagaattaattctgttctaacacagtattttattcaaacctttgaacatggacaaacttcattatattttatttctatttgcaacagttttttccttagctagattataaacccttaaagtccacgtcacttcttattctttatgttttcagaatttaacacttaatctaaatagtagcaactcttaaatactaccagcaatgtaaatgtttgtgttttatctatgttcagaagaaacataacagccaatatgaattggataatagatcttcaataacatttattttaaatgaatgcatggaaacagaaatcatttttagtctcctcatttatgaaaataacctgaaaatatcaggaaaatgtagtaattattgatttaacaccatagttactcttaatgcagcagatgtctaaacatataagctaatgataaactgaatattcagatttccctaaaatttttattttatttttatagctgagtaaaggaaagtaagattagttaaaccagtacttctgaaacccatttgaatattagaattatttagagaattaaaaaatataattctattaaaatatattataataatatatatacatatcaatcatatataaattttaaaatacgttaaaaattctgtctcttgaaaaatttttttaagtttgggtaggacgcaggtagctatagttttttttttcttgtcttgtatagtttacatttatcaatattattttaatttgacaggctataattttatttatctgtggggtactatgtgatgttttgatgatgtatacaatgtgaaatgattaaatcaagctaattaagaaatctaccacttaaatttttgtggtaagacatttgaaactttctgagaaattttgaaatgtacaatacattattattaactatcatcaccctttcaaaaacatattcctcctgtctatggggtaatgtggagtgaataaggagatgttggtcattggctcttcaaagttttgtagattagtactactcatcaactcccattctttgcaatgttcattaccaggtgtataaaagaatacagagattctgctagaagttaaatcacaatcaacaacgtctgtgaagagactgtttagttcagtgaacaatgtttttcattgcaaactttctcactgaaataacatttcaactacttgtaaagtaggtgattgtcatgatgtgatctattgatgtaaactattatttttattgttgttttgacataggcatgaaaaagaaaaaccaaaagtttatcactaaaaccgggataagcaatctcttccaggaacaatactcttttcaaaataatctttatttaggtcacttagttcattaattttgaaaattaatatagttctttttcttcctacaataggattgctttatttgtctacacttttttccattatgtttcataatgtttccaccataatagttctcttacattctttatatctttaaaaatatcaatttgctggagaggatgtggagaaataggaacacttttacgctgttggggggactgtaaactagtttaaccattgtggaagtcagtgtggcgattcctcagggatctagaactagaaataccatttgacccagccatcccattactgggtatatacccaaaggactataaatcatgctgctataaagacacatgtacacgtatgtttattgcagcactattcacaatagcaaagacttggaaccaacccaaatgtccaacaatgatagactggattaagaaaatgtggcacatatacaccatggaatactatgcagccataaaaaatgatgagttcatgtcctttgtagggacatggatgaaattggaaatcatcattctcagtaaactatcgcaaggacaaaaaaccaaacaccgcatgttctcactcataggtgggaatttaacaatgagaacacatggacacaggaaggggaacatcacactctggggactgttgtggggtggggggaggggggagggctagcattaggagatatacctaatgctaaatgacgagttaatgggtgcagcacaccagcatggcacatgtatacgtatgtaactaacctgcacattgtgcacatgtaccctaaaacttaaagtataataataataaaataaaataaaactgtaaaaaaaatcaatttgtatataattttactgagtaattcattctctttcagaaggaaatgacatggcatattgcaaaacagaaaagttactgtcatagtttatatgacaattagaccatagatataaaaaccatcgataataaagatacttttcttcaccttaaatagatgtttgtaaaaattaaaatggttataaaaggaatatttataattatttgtacgtaataaataaaaaatcacactttagtgtcatgaagacttaaatgtagccacatttttcaatactgaatagagtttattgcttctctttctcttatgtcatccaaattatttaattcatatacattaagtaatgttcttctattcttttgttaacttttttcttacacttttctaaaagaatcccattttctgctgcctgaaccttttaaatactaaatatttagaagagctactgtgtccggaatttattttttccggtgggttcttggtctcactgacttcaatgaagccacgcaccctcgcagtgagtgttacagttcttaaagatggtgtgtccggagtttgttccttcagatgttcagacatgtctggagtttcttccttctggcgggttcgtagtctcgctgacttcaggtgtgaagccgcagaccttctcagtgagtgttacagctcttgatggtggcgtgtccagagttgtttgttcctcctggtgggtttgtgatctctctgactttaggaatgaagctgcagaccctcgaagtgagtgtcacagcttataaaggcagtgcagaaccaaagagtgagcagcagcaagatttattgtaaagagcgaaagaacaaagctaccacagcgtggaaggcaacccaagtgcattgcgcttctggcttgggtggccagcttttattcccttatttggccctgcccacatcctgctgattggtccattttacagagctctgattggtccattttacagagtgctggttggtgcatttacaatcctttagctagacacagagtgctgactggtgcatttttacagagtgctgattggtgcacttttacagagtgctgattggtgcatttacaatcctttagctagacacatagtgctgatttggtgcatttacaatcctctagctagacagaaaagttctccaagtgtccacccaacccagacgtccagctggcttcacctctcattacaaattgttaattagtccagaaagcaatttttaaaaaatgcatatccagctttcctcccaaaattgtaccactatatgccaaaaaactaattaggaaataatcagaacacagttttaattttcttatagcttcttttggaaaatgattggtagacatcatttccataaaattagctcttactaaggttactgtagccattcatgttgtccatccctcaaattttccagcctttttttcttttcatgctgttggggtttttttctttatttttttatcttattatttgtattaatttacgggttacaagtgcaatttttttatatgtgtagattgcatagtggtgaagtcagggctttcgaggtggtcataacctgaatgacatacattgtacccattaagtgatttgatcttccagtaacattcaccattgttaaacagtcccatttccttccaaccctttagtcccttgcctataatgtcttaacactgattttatttaatttctacattttccgctactacttctatatctgttttgccatcttgtcttcttccatccagcagctacatgtgggatttttttgcaattgggtctcatcaatcttttcttatttaataatcacgtgcattcatttactcctgtggtttcaaatatcacctgtatatggatggtcactatatctgtagcctcacaactgctccaaatgccaagcctggatagccaaacatctatgtagcgagtcaaattacatatgtgaaaggctcctcaaacagaacttgttcaaaaaataaaattctgattttcttctttggcccacagaattacatcctttttctgatatttcatctttcagggaatgtcagtcccatttgtctagcagtagaaatctgaaacttaagaatcatcttgacaccatctgtcttatatcaaattaaatataatccaaatcctgtcattttttttaggtttattacaaatcttgtggttctctcaactctaataccaaagttcttatcctaaccatcatcatctctcactttaccaagtgcactattgtgctagagggtttctctacaaccatttttagccttttccaatcttctcgctacatttcaagcagtaacaagtttaaaagaaaagcaagcttagtcatgtttaaaaaggcttggcttccatcacttaaggagataaatctcctaagttgctatgtaaggctttgcatagtctgtgcatctatctctccatctgcaactttgaccactctatcctttctctctatgctccaggcattttctttcctttttatatagtatatctatttctatgacactttctctcctaagcccactcctttaatctggttatattcaacacttctttcagatctcagctcaatcaaggagagccttttatgatctatctgactagactactgtcctcactacaggggagagttaatttttggttcactcctgcagccacagagtatagaggtgcctgacacgtgggagacaggtgataagcatgcgctgtgtgagttatcatcagctacgcacctctcctttgtcacatttatcttaattttaattgtagttatttatatgattctttaataaatacctcccttcccatgttagacaatgagcgccatgtaagttggaaatgctttgatattttccacatgcacgtgatgccccagcaactcagtgacttgctcaaaataaataatttacaaataatattaaatgaaaagtattggttaaaagatgaaagcatgaaatattttcctaaaattacttatgtagtttcctatatttagacaagaagcttaaggatctaagttgactggaagatttttataaggttttctaatggtttaaagaacgatgttaagttgacttttacctcagttgtgcagacgcatccatgtctcagcgctctcaaatgaaaaagactttggaggctttaaaaaggtctaaactactgcttttataatttgatgaaagaagaaaggtaatattcaatgactcctgagatcgtctgtatgatcaagaattcagaagcatgcactatttttacgtatttacgtattttaagaaacaggatcttgttctgttgcccaggccagagtgcagtgatgggatcacagctcactgtacccttaaattcctgagctcacatgatcctcccacttcaatctcctgagtagctggatctagaggtgtgcacaaccatgccagctatttttttttgttttttgtagagacagaatattgctatattgtgcaagctggtctcaaactcttggtctcaagtgatctcccacctcaggctcccaaagtgctgggattacaggcatgagtcactatgcctgaagggaagcatgtattagaataagaaataaaaaaatataagcttaatgaatttgtgagagggatttcccagcaaatatcaaggattttaataagctctcttttttcatatgatgcatggatggattttttcaggaaagaatgagaaaggaaagggcggggcgtgagaaagagaaggaagagatcactccctgagtatatttgtgtagaattcaaacaaatgataccttgaataagtaaaaattaatcctaacaacctattgtattatcaggtgagtgtagacactgagaaatatctgattcaatatatgttaaaggaaaactggcagaaatcattaaacaaataaaccacatagttgcacaagatgcttaaaagatgcatgggcaaagacagtaagtattttggcaaaaatgtctagtgactgattttaaccaatctccatgccattgccaatcaattgaaggtaaaaatgataaactaagggtaaataaacttttatttttctatattcaagtcagtaatttcttcctattacttcaagaagaaaatttaattgttttgcgtttacatgtaagatcagttttaatttcttttctctcaaacagaactggaaatgatatgtttactaatacattcagtagcatgttcttaaaaatgcatctgtctgcaataaaatagataatgggtttcttccaccctcctgctccaaattagtgtacttgcagtattgagagtttaaggcaatatcttagtgtccttacttgactttgctgcaaatcattaggtgaaagattcaaactttgctttgcaaaataacaccattatttcacataaattcaaagaaatattacttaatcatgtattatttattcatttaattatttattttcaaataaatatgtattaagcaactatcttgtgttagagttagtcactaactctagtgaagtgaagctgaaaataagagtaccaaaacaagtggtgttaaaggtatgatgaactgatctttgggttagaagtggttatcgaatgttggagacaagtgggacttaaagatttttaagttgagcatctgcatgggcaggcaatgtgtctaacagtatggagagtatagatgaataatgatgagactggacatggcataaattctaaggccatctaggacaagatgctcaggatgccataggttgcacacatctggaaaccacagatactgacttatgagacagcaagaggtatttaagaaatctatgtaggatagtgtttaaagaaaatgagatcaagtactgctacaaaaatatcaactaagccaaagacttaaaataatcactgggtttaacaattttgaggtaatgacttttgccagtaactttgacccaatgatgcacattttttgagtcataaagtgtggaggcaatgaggtgatgtaagagtgagataattatggatacaacacatttggtcagatttcccaaagtcattgaccatttgaaggggctaagatatgcaagtagggaaaaatgagatatgcaaaccaatgacggaagtctaaaatacaataggagtaaaacaattgaaaatataggtagaaggaggaaaaggaagcattttattctctagtgtaagcaaagttccagcagttcataaggggtgtgtgtgtgtgtgtgtgtgtgtgtgtgtgtgtgtgtgtgtgtgtctttggaaatgaatggaataaaacagtgctcttagctaacacagtttccactgaggataaatatgaactgaacattcagttaggcaattctgttcctttgagtatatatttttagctaattcttcatattactgttcgtacagtgtagcatactcattatattcacagattctggaacctggcttgtcttaactatttatccgctgtgtgaatgtcaggaggatatttaacctctctgagaggctgttttcttatctgagaaacagctatagttgcagtacattttctgtaatgtttttagagataaattgagatagtttaagtgtttggcacacagcaaatattaataatttaaaaattagtgttttaaactctattaaacctacttgtgggttttgttgttttttatttggtcactattttctcaagagcagtttttgggtgtctgaggtaacatctaaacacttgattttttttgaaaattctttaaataatttggatgcatatgcaaggctgtaaatgactataccagttatactcatcctggttggatatgtggctagttggttagtttagcacaggtcctctcccttgccttgtgtgttaaggaacaatgggcaggcagcccctgtctatctaccagtcgtaacgtgccaagcacatatgagatgtttttcagactgtatctcacttaattctaagaacaaatctatcataaattctgttatttctattttacacgcgaggaagctaaggctttgagaaatgaaataatttcataagcttaaattttaccttagcatcttattaggatactaatttaagtgagactaaattatttcataagtaacagataaatttcaagttgccacaacttccattgcaatatgctgcctcctttaacaattcttttagttttatgtgaatggataagaggaaaataagaaaagaatattgcaagacttctctggcaattcatattttacttggcatgaggataaagagacaactgacttgcgagatttgtcaaaggtaggcaaggtcttcttaatgaggtgtcaatctttctaaaggactataacacactaatatgtaaaggtgttttgccactatgatatgcctttgacgaaattatgacatttattatggagaaacaatgctctctggtgtctaccgtcaagggtttccttcagttgtttaatttggaactgccacatcacaagcaagttatacaaacaactctttgtgtggaggtcattatattgtctcagatatgctaggatttaagtagactggcaggacaattcacagagacaaattcacaaaatgtagtctttttctttcttaaggtattctgaaaaattatcatgaaattatgcaatcaaaagccaacttactttaaactccaaaaaagtgtcatccttgcagttacctacatggaacatgtttcagctaacttaagccccctcataaacattctgtaactaaataaatataatgacttttataggcacaatttacactcagtgtcctcattattcctgacattctaacaaatttagttgttttaatgtagtaagtataagcagtatttagaagcatttagaagtattaaactcacataatacatttatcaaaagtataaagcgatgctttaaggtgctaagattagcaacttaaaaacaacatgccaacctaaacattcagtaggcattgcctttcaaagtagttacttttagaaaatgcattatttttattatcttgcaaacatttatttagtacttaacatgggtaaagctacatattgtggcacttatccaagtatttccttgcatttgtattatctggattttggctttaatccccactaagtttcacacttttcatagaaagaagtgaaggaataataactggaagtttttaaatattcatattgatgtataatattgccatatataaataatccagaattaaacatatatttcataatcatacaggaaattaagaaatagatgatcaggttttatattcttgtaatgtccaagaaaaataaattaaacctacatatcatgatttctctggcaattcatattttacttggcacaaggagctaagtacatcctatatcaaatgccatggatcaatgtttcccaaaatttaaatacgttctactcacaatgtgtataaaagatgatctatgggaccaaaacacagtgaactacacaaagaaaaagttccccccaattacattattttctagtttataaattactgtaatcaacaaattgaggatctgctgactgttgggcattagtgtaggttctgagtctgcatcttgaagaaaaatgaagtcttttagcatattttgggaaggggcaaaaatgaacaaggaaacaataaatactctagtaagggctatgaaaaaggagagagacaacctcaggctaagaacatttcgtgggcaccagcatctgaagttaaatgtgataacatttgtttccacaagtaacttataatttatagcataatatattgtttttctatttatggtagtaatttatagtttccttttaaaaatattgtattaaatttcatattactttaaaataaaatattaaattacatataagtggtgagtgaatgtagcaaaactgaggagatgacatgttctctactgtgaaaatgaattaaatatcagccattaatactatttcttttcgaggaaaaagaggtaatgatgaaaaaacaatctaatatcatgtgaacataaagagaagagaaaaataatccaaggaaagaatacactttattaaacatatctggcatttgtttcggccattcaatatttggatctatttcttatgacatgtttgagtttatttggaggaaggtaactctccctcttccttgaagatgctcagactttcctgcactcacattctcagactcccttacagcttggatgcaggctttgccaatgagatatactcatggtatgtgtattagtccattttcatgctgctaataaagacatatctgagactgggtaatttataaggaaaaagaggtttaatagactcactgttcaacgtggctggggaggcctcataatcatggtggaaggcaaaaggcacatattacatggcagcaggcaagagagaaaatgagagccaaatgaaaggggttcccccttataaaaccacccgatctcataggacttattcactaccaagagaacagtatgggacaaattgcccccatgattcagatatctcccaccaggtcccacccacaacacatggaaattacgggaactacaattcaagatgagatttgggtggaacacagccaaaccatatcaatcggtaaaagtcacacacacacaaaatgtagagttgatggagaatcgtctctggcagaagtcagcattgctgcaatatgcagtgggattcacgcacagggccagaggtgtggatatgtgaaaatgcagttctactgctggtgatagatctctggcataattttagatcttgtttctggctcagcagtacccaagcctcaagaaaattagtaatttcatataattttgataaattcctttgtgtttaaggcaaccacaatagtttctttcatttacaactaaaaacttgaactcatgccaacaaataagacgggaaggagtatacatttattaccccatggtcaccagcccttggcacaaaaatatcaataaatattgaatgatgaaaaaatataaaaagtaaattagtcaacctctatggaaaacaatatagagatttatcaaaaacctgcaagtagatctaccatttgatccagaaatgcaactactgtgcacctaccgaaaaggaaaagaagtcattatatcaaaaagccatctgcacacatatctttatcacagcacaattgacaattgcaaatatttgtaatcaacctcagtgtccatcaactcatgggtgaataaagaagatgatgtgatatatctatatatctctatctctatctatacaccatgaagtactacttggccataaaaaagaatgaaataaagtattttgcagcaacttggatggaactggaggccattattctaacggaagccattcagaaatggaaaaccaaataatgcatgttctcatttacaagtgggagctaagctatgtgtacacaaaggtatacggagtgctatgataaacattgtagactcagaaagaggcaaggtcgcagaggggctaggaataaaaaaaaatccctattgggtacactgtccgttattcggatgacaggtgcactaaaagcccagacttcactactctgcagttaatccatgtaaccaaaaaccacttgtaccattagctattggaataaaaataaaagggtttttcttaaaagaaaataacatagttttcctctctttcaaagtagcagaaatatacccccccacaaaaaaaaagtagagttgatggagaatcgtctctggcagcagtgagcattgctgcaatacgcagtgggatccacgcacagggccagaggtgtgaatgatgatgcttttacttttcattttatttctctattttctttaacttggattcagaaagattaacttttgtacagcactgataaagtggtctgctccaaaactctttagtagcaacactgattgacaaaataaatctgacatgcatgtcagctattttaaagtagaaatatgttagaaattgtcatggcacttgaattgccatgaaattccaaatgatcacattaagtgataatttgggatccatatataaaaagctgtaaaatcagtaaagaaaatcatgtttatcataaaaattttagtttaataaagacaacacttaaactaagggcactggaacagtaaaaatctttcccatttctcactgtgtaaagagattacttttatcctgcaatgagatttgcagagtactgtgccacaagaaaataaaggatttgagtgatatattaagaaataaggagaaaggcaatatatttgaaattcacacaagaacagaaactggaaaatcacacatatacccttaatatctactgtaagtacatatactgatcataagttttgtagatatgcatatatttcattcaaaatactcatgccaataacagagagtatctatctgaggctttcaaatccccaagaaattatgaagagttttctcaccatgctgtgatcttttctagcagaagctccttcactttcataccccatatatctcagggtctgaatgtcgtcagtgtcttccctggttttggtccttaaagccaattgcaaacgtatctttaccttcctccttcaaacacccagctacattgaaacacaggccatcggcctgtcccagtggcaatttaagcctgtgagtatcaagaatctcctggtgatcagatctcctggtcaccacccttcttttatgcatgggtttgaccactgactcactctctccatgatgtgatttccatagtcattattgaatttgatattcaatatccaaattctcatttcattggtattcttactcctaacagaaacatacttttctcagccacagttctgccaatcacaatcttaacagcgagtttgctcctcactttctcatcccctctcaccctctgattctggctctctctctctctccaccaacctcattccttaatctgcccctctctcttatgtcatcatatgtatttgtcaaaaccatatcccagttaactatttgcttctcatctactccttttctacaacattgtatctgaatatattgtttaaaaaaaacacaaccatgccgaacatgctgaatattctgtttaagtgtttaaattcatcaaaacagatctgatgtgggcgattaatagtattgttactatgatgccatgattaataacataatgatattataacacttatctacttcatgcattcttttgattttggagattacaatttcatacaatttcttctctccaaactttctccacatcctctcccatgctcactgttaacagatgatcttgcgtcctactacactgaaaaaaaattggacaattaagagaattaagaggaagatatccataactccccaacctctatatcacccagcaaccagctcttggtccaatatgctcttcatttcatcctgataatacagatgagctgttcttgcatctgaaattaatacaagaatttgtgaaatgtctcccaatccatttatttcattgtttccaggctcatgatctaggaatttccaagccctttctttccagcagcataatttttcccaagctactatttattaccatacaagtatgataggtctatttttaactttttgttgttctcaaaatacaagctgtctcttgattctacttcctattgtggatttttttcttaaagagtttgagcctcctcctcttccttctcctcctcctccttcttgtttatttaatccgttctagtttgtttcccaaactcctcaagactgtttttcttcaagatcacttgtacaaaattgaatattcaatgcataattcccactttactctgtactcctggaaatatatgtctcaatgaatttataggattatatcatgtatcaatcaaggttcaaccagataagtagaataaggacaataaccaagtaatacttctgccttgcatgacaactattttacttacaactaaaaatatactaaccttctcctgagaggaggatgtaatttcctcagataatattctctcttctctcttggtatcctgtaatgtaaatattgtgatataaagttaattattatcaatgtatcttgtgttagatgataagggtataaaagaatagaataaaaatatctagccaatatatacataagcatatttataaaaaagtgagaaataaataattatacctatttgggtctttatttctgcaagtggttatgtggtcatagatggtatttaaacccatttcttacatgatcaattctagatcctctttgtcctcagcaagcatctcagctagtgatggtccttcacctgatgggtgactcaaatgctcatttctgaatgaactgcaccattaacagtcctgcctaaattggtttttgtaattttctatggactataatcacagactattatagtgctaagagatggcctaaggtacctgtattccatacgtattgttcttcacctccaatctgcagtagcaactcaatttcccacttggtcatcaggatcaatgactccagccagttcagtaatcctgcactttgcctgttcattcagagacatgaggaatccaaagctgctgggtggttggcctcaacatccagttcaatgcaatcattgttgcttttcctgatggaggcatttctccctttggaattaagacatctagactaacagagcctaaggtcattgggatgggaaggaaaaaccttgttagtgaatcactaggggtaattgtttgtggaaccaatccacttccatttgcactccttgtttcctggacctgtgaatcctggctatgggagaaacagtagtatatattgggtgctaatttagagcattctagagaatttcctggagaaattaccccagaaccatctctaaaccaggtccatgtctttccttcttctgtcaactggttatagagaactccggatgagaccatagatccaggctgggagtgagaaggtcatgtagcacaacttgccttcagggcctggcttaagcccggtctcctgtctactgcttcctctgacaatggagtgctgctgtgcatgcccagtgttatggcttgggaggagccacagccagtaacatgtcatatctcaaaagcagagttgttatccagagaagaaggcagggttttgctacaaaatccttagagtctgcgctacaattcgctgatagagcctccaaaggatgcaaacagcacatctctcattgacacttcaaccaaaattggatctactggatcacatgacccaagtagcagggaatgttgcacaacagccctgacttgtttcaaaatactctgttgttctgggtctacctcaaagctatcagcttgtggggtcactggctaactaaaccagggtagcatacaaaaatgagaaatgtgttgcctccataatccaaaggtgctgtgcttcttttggtagtaagaaggagtagatgcaacaatttattttaactttagaagggatgtcaacatacctcgtatcactggacccctggaaatttcacagagataaagggtgcctgaattttttgagttttatttattttctctgacacatctagaataattgctatctgtctcaaactaggtccaatcagcacgatatcatcaacgtaattgagcagcatggcatcttctggaggtgaagataaatcaagatcccatggattaaatggtgacaaaggtctagagagctgatataaccctgaactaggttagcaaaagatttcagctggccttgtcatctgaaaacaaaactacttctcgtggtctttagtaaaaggtctagagaggaaaaaaaaaaaaaaaaaagcattttccaaatcaatagctgcatgctggttaccaggggatgtattaatctgctcaggaaacaaaagcacatctggaacttgagctgcaattggagacaccacctgattaagtttataatagtctgctgttattctccagcatttatctgtttctctgtacagaccaattagacgagttgaatgaggatgtgttgaaaatcactacccctgaatccttcaattgcttaatggtggcagtaatcttttcaatccctgcaggaatatggcattgcttttaatttaccattttttcaggtaaaagagtttcattagcttccattggcctccttaccatagtaagctcttaagccataggtcatggaaacagtatggggactctgcctactgcttgtttgtgtacttcaattattcattctgaaacctgagaaataatcacaggatgagtttggaagccacctagacccatcgtgacactgatctgagctaaaactccattgaacgacagatccacagaagtctctactgtgatcggtggacaatcatgatgtttcgggtctccaggaattactatgccagtgttcacacaaaatgtagaagtgagtaaatttgttgtttaaatttaagctggttaacttttattgaaattatttgaaattaaaaaatattcccatttaaataaaattcctgacccagatagcctcaacagtatattcttcccaatctttaaggaagaaataaaatcaatcttatataaactcttttgcagagcagatataaatgcatacttcccaacgttttttatgagggaaggttatgtatgacatgaaaacttgaaaagaataagaaaaaattatacagtagttactttcataaacataaaggcaacatatcactccaaatagtagaaaattaatttcagcaatgcataagattgataatatatcatgatcatgtagaagttttatcacgttatgcaagacctgttaaatatccataaattaattagtataactatttgttttaatgggatgtatactgtggtgagtcacctaaatttatccatgcccggaacggaaggattcatttagccagttgctgggagtgttcatgaacgacagatcttaaattatggcaggcaattgaaactggttagagagctactctatctatgttccctttggggagcattctaaatcctatgtcacttttgcctgaattcaggaaaatactgtaaggccaccacagctccacagcttcccatgagatgtctaaaacctttgttttgactatattattgcatgctcaacttctcccactgcccaatcctattgtctttacttccccacaagttttgatcctgagacattcccttactagtactccacatgcaaatctttatctcaaaatatatatcctaagggatctgtcctatgacattacattaacaaatacaaggggaaacaccatatgttattctcaacagatcctaaagtgcaatcgaaacaaagtcaacaaacattctttgatatattctcccaggaaacaagtaattgaagagtacgtctaaagttaagtgtgtgtagagaaaaccaagggaaaataatataagaaataattttaaaagctttacatctgaaatctaaatatagttgcccattaatacaaattctattcaacaatatactacagcagaggttggcaaacttttttcataaaaggacaaaaagaaaacatttaggcattccctgtcagagtcattgtcacagctgttcaactttgacattgtagaatgaaaccagggacaataaaataatgaagagttctatgttctaataaaactttatttacaaaaagagatgttgggctgtgtttgacctgtaggagtttgtcaactcctgttctagaatttatagtgaatacaataaaataagagaaataattaaaatagaaagattaaagaagttatgattgtaaattaatgatagtatacttagaaaattctaaggaatctacctatcatatattagatttaataagtatagttattaaaatgtcaaaatacaaaattaagtgtatttctatgtccaatactcatagaataactcatatcagatagaccctttcactggaaacacataaactctagaaagaaaaaataatagccacaacaaaaatagttgaagacaatttatagcaattaaaaacaggcagaaattagatattttagggaaggtaaaggcactgaatgattttcctatacccatagctttttgccacaagcagatttcagtcagttatagtgcaggcaattaatatttacatagaatatcacagttttcctgtccttaaaaagcagaagttagagttaggggctaccagagtaagtaaaagaaatgtgaattccagaatgtgaaaaccgcacaaaggaaattaaacattctttccaaatatcaagctgcccctagaactacacaggcccaaaccaggctccaatcaacacggctaaaaagtaaaaaacagattctggatattagccctttgtcagatgagtagattgcaaaaattttctcccattctgtaggttgcctcttcactctgatggtagtttcttttgctgtgcagaagttctttagtttaattagatcccatttgtcaattttggtttttgttgccattgcttttgggtatgtttattgcagcactattcacaatagcaaagacttggaaccaacctaaatgtccaataatgatagactggattaagaaaatgtggcacatatacaccatggaatactatgcagccataaaaaatgatgagttcatgtcctttgtagggatgtggatgaagctggaaaccatcattctccgcaaactatcacaaggacaaaaaaaccaaacaccgcatgttctcactcataggtgggaattgaacaatgagaacacatggacacaggaaggggaacatcacacaccggggcctgttgtggggtggggggaggggggagggatagcattaggaggtatacctaatgctaaatgacgagttaatgggtgcagcacaccaacatggcacgtgtatacatatgtaactaacctgcacgttgtgcacatgtaccctaaaacttaaagtataataaaaaaaagaaaaaaaaagagtaaaaaacagaaaatatatttaatctactgtccatcagataggagataatctttgtagtctgaactaaactaaactgctaaaaaacaaagaaacaatcaaattaatcttcaacattcttcagataaataaagcgagcgagtgcctctgaaaaaatattattcacaatgcttcaaagaccaagataaactcccaaattataaaacaggaaatataacgcagatctttacctgagaaaaatgatagtcagtgtaaacagacaccacaattgcccaaatattgggattagtgggtaagtgttataaagcaacatttttaactatactcaagaatgtgaaattacatatgttcataataaatgaaaaaatagagaatctcagaaacatcatacaaaataatagaaaatctataaaaacatatttatccagttaacttgaaaattaagaaatagaaattacctaaaatgaagaaaagtaagaaacaacatataggaagaaagtgaatgagacctgtgtaggctgtgagataatattccaagttccaaaaaaaatgtgtaattagaggctcagaaggggagagaaatgaaagataaggtaacaaaacattcggataaataatggcaaataattccccaattttgctgaaagacatacgtttacaaattcaagaagctaatcaaaacgcaagaaggataaatatttttaaaacaaacacattattagacacagtataattagaatgttacaacacaacaacaaagggaaatcttaaaagcaactagagaaaaatgtcattacatacagaggagtaacaagaatggctgctgacttctcctctgaagggatgaacagcagcagacagagaaacaacgttgtcaaagtgaaaaaaggggaaaaatgtcttttttttttttacttttttttttttttttgagagagagtctcactctgtcgcccaggctggagtgcagtggcgtgatctcggctcactgcaagctccgcctcctgggttcacgccattctcctgcctcagcctcccgagtagctgggactacaggcgcccaccacctcgcccagctaattttttgtatttttagtagagacggggtttcaccgtgttagccaggatggtcttgatctcctgaccttgtgatccgcccgccttggcctctcaaagtactaggattacaggcgtgagccaccgcgcccggccttttttttttagttttttttacttttttttttttttttttttttttttttgagacagagtctcactctgtcacccaggctggagtgcagtggcatgatcttggcttactgcagaaaaaaggggaaaaatgtcaactcagatttctatatgaaagaaaaatataatttaagaatgatggcaaagtaaactcattttgagataagtaaaagcaaacaatttgtgagcagagtccctgcaattcaagagacaacaaagagagatcttcaagctgatgggaaagacattactagatggtatctagtaataggagatagagagttgggttttcacaaaggaataggtatgagtgtttatagctgttctaaagatataatctttaatagtcatttaaatgttgaaaacaaaaattataagacttttatgaatttatatcttatttagcttatataaaatatttattatacataaatatagagaggctataaacagtataaacaatagggcagggcaattgtaaggtaattattgcaaggtaattacacttagtgtagtgtcacaatattaaattatacagactgaaaaggatttaaggatgaatatcttagtaattacagtgaccaagacaaaatataatgcaaagaggtttaactaatatgtcaatatgccctgaaacaatgactattataacaaaacagttatggtaaataaacctccaaaaaaaaggagatctaaagaaatcgtaggctgaacgtggtggctcacgcctgtaatcccagcactttgggaggccaaggcgggtggatcaggagttcaggagattgagaccatcctggctaacatggtgaaatcccatctctactaaatatacaaaaaaattagccgggcgtggtggcgggcacctgtagtcgcagctacctgggaggctgaggcaggagaatggcgtgaacctgggagacggagcttgcggtgagccgagatcgcgccactacactccagcctgggtgcaagagctagactccgtctcaaaacaaaacaaaaacagaaacaagaagaaatcataaaaataatcaattaatccaaaacaggaagaaaaagagagatatgatgtatattacagttttatctccaaaaatttaattttaagttttttaatataatttcagtgtatctaacttttaaactttttgaatatatgaaatataattgcaataacttttaatgtccatctgctaattcaaatatgtgtgtcagttcttggttggttttcactgatttattttttatcagccttttcgtcaggggtcatattttcttgcttctttgcatccctggaaagtctttttactggatgccaaacctttgaatttactccgttgagtgctggataattttgtgttcccataagaattattgagttttattataggatgctgttaaattactttaacgtggtttgacccttttagaatttgttaggtgggacctgagcagtgttcagtgtgcagttattctccactacggaggcaagacctttctgtgtactttcccaatgctccatgaatcttaaggttttccagtatgacttctgggaatagacattagtcctggcccttttagagcaccgtatattgctaacatttgggaagtttccttcttcaatctcttttgtttcctgacacacgctctgattagtacccattgaaaccctgggggagatcctttgcagatctgggagttctcactctgcagctggtttctctctgatgcgctgtcctgcacactaagttactttgctctccccaaagtctcagctctgtgtcaactcagggaggctgctggcgtccattcttactccgtacactgtgaccaggaatctctctcaatgtaaaaaactggtgtaatcgtgggactcacttttatttatcgtaacttaggggttactttcttctactttttgaggttcagcgttgttttcatttatcctattttggctgttgacgttgagtggatatatctggtccctatcactccatcttggttgtaagcagttgtaaatgatttattttctcagcttttaacataatatattccttttaacataacatgctatttactaatttatattagtactgtatttattatgagggctgtatttcctaccttcatagtgaaagctctattagggcaatggttttttctcttttgtttagcagtgtatccagtgacgagaatagtgccagacaaatagcagaaagtaaataaacacttgtattctttacctcacgctcctcaatgacagcaaacattacgaaacctgatgtcgccaccacttctcattcttacagattcaacttccatattcttactccatttctccaacctcacagtaacatccctgccagatgtgctacttcctcctcactttctgtcaccctccacttccttctccacgactcagcctccagttcatattcatatattataatcagtcttttattgtccctagactttctcatccccatttttcttgttgcatttggctagacaaaactgcaattctactaaaactaaatatcaatctattccattgtaataccgaaatcattcaattttgctaaagaaaatggcaagacctgtttgaccaatctcatcatactaaacaaatgactgtatatcttaagtagagtctatacactctcaatataatccttcttttacatttttgccccacataaaacaaataatgtgtaactctacccctcttcccttctcaagaccctatcccaagtctcacctgataattttctcccaagcctttatttaacattaggttaagtcagaagagaaatttctgccactaaagcaaccagcctgtctgcatctcttgccacataatctgccttgcttcacaacaatacaatagaagaggtatctttgctcctatctaagtcttccccaccatttgtggtttgggttttgtctgtttttactcatcaggcaaccttcaccatacatttacccctcatagtcctttcaccatcaggttacttcttgctcatagatcattgcccttagcattcaagcatgtcatagaagttcacatttttaaattcaattgaatacaatacaaaaggaaatagttccctttcatcactctccatctccctccaaataccattattcatctctcctcaaaataacccccagaattgtgcacactcattggttctgctttgtaaaattcccactcttttcctcacctcactctattcctgcttttgttcccaccatccaattagattgtctagtactgaagtttccaattacctacatactgccagccacactaattagtcatctcatttcaccctacttgaccatgctttgacataattaataccctctccttctcaaaacacttttattttcttctaaaagaatcagatttttttctcttctgatttgtctcttagtcagtttttattctcagtatccattactaaccttttctttgtttttaccactaatgaaatcagtgagccaggactctgttctaggacctgctctcctctgtcaatcttctctccagaggatctcaggcaacaccattcttttaatatctagtgtttgttgaaaataacaccaggatatcagatggttcataaaatttgtatttatttcaaatgatggaagaacaaagaaagcaatgataatgataacattaacatttttatatatgaatttccacaacattaatttctggggaaaatattgacctttagaaattttcataaaacaatatactaagagtctaacaaattaaccaaaatgacttttcttatataaacatttttatacgtataagaatatgatatgcttattgtagaattcatagaaaatacaaactctgtatcagaatataaacaacccataatcttaatattgtaagataaacgctattaatttccgttttgcatatagttttatagtgttacttgcttcttttacttatataatataaacatttctgatatgaatgaaatgcttcatcaatatgtttgtcattttctttaacagtccattcaaaatatgtattgtaaactggtgttggtggcttacacttgtaatctccacactttgaaaggccgagttgggaggatcacttgaggctaggagttcaaaaccagcctggtctatataatgagaccctgtctctacaaaaacaataaaaaataaaacattagccaggcatagttaatccctatagtcccagctacttgggaggctgaggcagaaggattttgagcttaggagtttgaggttacagtgagccatgaccacaccattgcattgaaacgtgggtggcagagccagatcctgtttcaaacaaaacaaaacaaaaatatattattaaaacaaaaaatatttccttttttcctattattacatagtatggctgtatttttctaacttctaataaaaattattctcagttaaataattttcttcacaatatctcttttaactttaatttttctgattttaggacaaatttttataagcagaataacccacacacaaaagtataaaactatttaagtcttttgatgaaaagtataaaaacaaatttttccaaattataacaattttatttctatccactcatgacaatattccttttacctattaaaatatttttttcattgtatctcatttattacatgtgaggatatattgataaaatctctcaagacaggaatttagcaacacagaggaaaagcctcagatatgattgagaatcttcaatccacaattctacaaacggatcctaaggacatactaaaaaaaatgaatttgtttttttttttttttttgagacagaatctcaatctttcactcaggctggagtgtgatggcatgatcccagctcactgcaacctctgcctcccaagttaaagcaattctcatgcctcagcctttcgagtagctgggattacaggcgtgcaccactatgcccaattaatttttgtgtttttttaatatagagatgtggtttcaccatgttgaccaggctagccacaaactactaacgtcaggtgatcccccggccccggcctcccaaagtgctgggattacaggtgtgagccaccatgcctggcctgcaatttgtttttcttttcttttcttttctttcttttcttttttttttttttttttgacagagtctggctttgtagcccaggctggagtgcagtggcacgatctcacctcactaccacctccgcctcccaggttcaagtgattcacctgcctcagcctcctgagtagctgggattacaggcgcgtgccaccatgcccagctaattttttgtatttttggtaaagacagggtttcaccacgttagccaggatggtctctatctcctgacctcgtgatctgctagcctgggccacccgaagtgctgggatcacaggcgtgagccactgcgccccgcctgcaatttgcttttctataaggaaagccagtccttcagtgttcagtttagcatgacaccttatggaaaacttctcttttcctctgctcaacttctctgccatccctcgtgctgatatagcacttgggcacatgtatgatcttacttactagataatcaaaattgttgaaactattagttgaaatgtattaaatgcttagaaagcatagttgataatattcgaagcaggttttttactcattttattatttattcatgaaaacaaatttctgatgtaggaatgacgttccgtattttatcactgatttaactactgctttagaaaggatgaataaatggctcaagttcatgcagggaagaaacgagagcaccaagattcaaacacaggcagactgagttgaaatatttcttcagtcagcgatgtatataatttttttctgattctaatattaaagttatattatgctttccaaatacttatggataaaagaaattagaaagatcttaaaaattaacaaatttcacaattgcagtattcacattattagttgtggatacctaccttccatgagctattgctaacctaataaaacattttttaatatattactggcaatgttaaatctctaccttcaccactatttgtacattaaattagaagaagaaagccttattgaaatgagaaaagagatattgcatgaaaataacagactccaaatatgaatattagataataaatatacttcagtcagacagtttggtcaaaagtgaagatgaattacagaatatagcagttctttgcaaacatttgtgaaaataacatgtgaatcttattgataaaatattcaggtaagtatatttttcattactatttgaccttatcaactatatcagggaaatttgcatgagccaatttttcaataaatattgcattatatattacacaaatagaaaatgaagaaaaaagaatcctgtgtttttataaaacatcagaagcacttttgacaggaaacaggattatctgaacaactgaatatttatggggaaattgtatacttagtatagagagatttgaactattaatcaaaaaatcattcggatgcagagaactctaaggaaggtgaaaattgtaaatcaaaatgcatatgtatataaatcattatttttaaggaggctattttggtagagcaaatagtagaaatgaaatattttacctaagactcagattctgataataccaggttatagctaaataagaaatgagaagaatttgtcttcatttaatgcttaaagatcatcactgcagagacagggatgatcagtgagccccgggccatggttctgcaaagaaaatgatgaactccacttactgtgtatgtactattgcctagagtgaacttacttttccaagctaggaataaacaataatattcttcagtatcatacttaacaccttgcaatgccctcacacacatgtttcttaaatgataggcttttcttttcacattctcatgtagaaatctggtacatgttcattccttggcagctgtgtaatagtttaaaagtctgagctctcagcaaaagaagacaaaaaagtgagaaaaagcctcattctgattgccagccaaataaatatatctttagaaagaggaggacaatttttactttgcttagtacctcttgaaacaatagagtcctgtaggacacagttgatactaatgggacaaatctccctatccaatcccagcttccactgtacttgctgagtgtgaggcctctgagccctagcctgcacatatacatgcagatggcctgaagcaagcgaagaatcagaaaagaagtgaaaatggtcagttcctgccttaactgatgacattaccttgtgaaattccttctcctggctcagaagctcccccactgagcaccttgtgacctccgcccctgccggccagagaacaaccccctttgactgtaattttccactattacccaaatcctataaaacggccccatccctatctctcttcgctgactctctttttggactcagcctgcctgcacccaggtgaaataaacagccttgttgctcgcacaaagcctgtttggtggtctcttcacgtggacacaagtgacgtttggtgccaaagacctgagatgggaggactcctttgggagaccagcccctgtcctcaccatcactccgtgaggagatacacctacaacctcgggtcctcagagcaaccatcccaaggaacatctcaccaatttcaaatcgggtaagcagtcttttcactctcttctccagcctcttttgctatccttcattctccctctctcgctacccttcaatctccccgtccttccaattccagttctttttcctctgtagtagagacaaaggagacacattttatccgtggacccaaaactccggcacccgtcatggactcgggaagatagtcttcccttggtgattaatcactgtggggacgcctgcctgattattcgcccacactccattggtgtctgatcaccacgaggatgcctgccttggtcattcacccacattcccttggtggcaagtcaattgtggggacgcctgctttggctgctcacccacactgcagcctagggctgctcaccacccccttctctgtgtctccacctttctctttgaacttacctacttcactgtgggcaaacttccgccctccattcccccttcttctcccttaacctgtgttctcaaaaacttaaaacctcttcaacgctcgcctgacctaaaacctaagcatcttattttcttctgcaacaccgcttggccccaatacaaactcaataaaggttctaaatagccagaaaatgacacttttgatttctccattttacaagacctggatgatttttgtcgaaaaataggcaaatggtctgaggtgcctgatgtccaggcattcttttacacattggtccctccctagtctctgctcccaatgtggctcatcccaaatctttcttctttctctcctgtctgttccttcagtctccaccccaagctgagtcctttgaatcctccttttctatggactcatctgacctctcctccccaggctgctcctcaccaggccgaaccaggtcccaattcttcctcagcctctgctcccccaccctataacctttctattacttcccctcctcatgcccagtcctgcttacagtttcattctgggactagccctcccccacctgcccaacaatttcctcttaaagaggtggctggagctgaaggcatagtcaaggttaatgctcctttttcttcatctgacctctcccaaatcagttagtgtttaagctctttttcatcaaatataaaaacctagctcagttcatggcccgtttggcaacaaccattagatgctttaccaccctagacccagagggccagaaggccatcttattctcaatatgcattttattacccaagcccctcccaacattagaaaaagctccaaaaattagattccagccctcaaaccccacaacaggacttaattaacctcaccttcaaggtgtacaataatacagtagaggcagccaagtagcaacgtatttctgagttgcaattccttgcctcaactgtgagagaaaccccagtcacatctccagcacacaagaacttcaaaacgtctaaaccataggggccaggcattcctccgggactgcctcccccaggatcttgcttccagtgccagaaatctggccactgggccaaggaatgcccgcagcctaggattcctcctaagctgtgtcccatctgtgtgggaccccactggaaatcagactgtccaactcacctggcagccactcccagagcccctggaactctggcccaaggctctctgactgactccttcccagatcttctcggcttcagcggctgaagactgacactgccctattgcctcggaagcctacaggaccatcacagacactttgggtaactcttagagagcagggtaagtccatctccttcttaatcaatacagacgctacccactccacagtaccttcttttcaagggcctgtttcccttgcctccataactgttgtgggtattgacggccaggtttctaaacctcttaaaactccccaactctggtgccaacttagccaatattcttttaagcacccctttttagttatccccacctgcccagctcccttattaggctgagacattttaactaaattgtctgcttccctgactactcctaggctacagccacacctcagtgatagatgtggaagatactatagcatagcctgtcttggctggtgaatggtgattaggcctttggaactgggagcccttttctccagttcaaagcctccttcacatcctccccttgtatctccccaccttaatccacaagaataggatgcctctactccctccttggtgacgaatcatgcaccccttaccatcccattaaaacctaatcacccttaccccactcaatgccaatatcccatcccacagtacactttaaacgggttaaagcctgttatcacttgcctgttacagcatggccctttaaagcctataaactctccttacaattcccccattttacctgtccaaaaaaaactggacaagccttacaggttagttcaggatctgcaccttatcaaccaaagtgtcttgtgtatccaccccatggtgccaaagtcatatactctcctaacctcaatacctccctccacaacccctccataacccattactctgttctggatctcaaacatgctttctttactattcccttgcccccttcatcccagcctctcttcactttcacttggattgaccctgacacccatcaggctcagaaaattacctgggctgtactgcctcaaggcttcacagacagccccattacttcagtcaagcccaaatttcttcctcatcctttacttatctcggcataattcttcatgaaaacacacgtgctctcccttctgatcatatctggctaatctcccaaaccccaaccccttctacaaagcaacaactcctttcctacctaggcatggttagatactccacctttagagacctagttttaccatcctgaccaaaccattacataaactcagaaaagcaaacctagctgaccccacagatctaaatccttttgccacttctctttccattccttaaaaacagccctagaagctgctcccacactagctctccctaactcatcccaaccctttttcattacacacagccgaagtgcaggactctgcggtcagaattcttacacaagagccaggactgtgccctgtagcctttctgtccaaacaacttgaccttactgttgtaggctagctcccacattattcctgatacgacacctgacccccatgcctgtatctctctgatacacctggcattcactccatttctccatatttccttctttcctgttcctcccctgatcacatctggtttatttttatttttatttatttattttttttgagacagagtctcgctgtcgcccaggctggagtgcagtggtgcgacatctggtttattgatggcagttccaacaggcctaatcaccattcaccaccaaagacaggctatgctatagtattttccacatctatcactgaggctaccgctctgccccctccactacctctcagcaagctgaactcattgacttaactcgggctctcactcttgcaaagggattacttgtcaatatttatactgattctaaatatgccttccatatcctgcaccaccatgctgttatatgggcagaaagaggtttcctcactatgcaagggtcctccatcattaatgcctctttaataaaaactcttttcaaggtcgctttacttccaaaggaagctggagtcattcaccgcaagggccatcaaaaggcatcagatcccatagctccgggcaatgcttatgctgataaggtagctaaaaaagcagctagggttccaacttctatccctcacggcaatttttctcctcatctggtcactcccacctactcccccactgaaacttccacctatcaatctcttcccaaacaaggcaaatggttcttggaccaaggaaaatatctccttccagcctcacaggcccattctattctgtcatcatttcataacctcttccatgtaagttacaagctgctaacccgcctcttaaaacctctcttttcctttccatcgtaaaaatctatcctcaaaaaatcacttctcagtgttccatctgctattctactactcctcaggaatttctcaggtcccctcccttccctacacatcaagcttgagaatttgcccctgcccaagactggcaaattgactttactcccatgccccgagtcaggaaactaaaataactcttggtctgggtatacactttcactggatgggtagaggcctttcccacagggtctgagaaggccaccatggtcatttcttcccttgtgtcagacataattcctcagtttggccttcccaactctatacagtccaataatggactggcctttgctagtcaaatcacccaagcagtttctcagtcttttggtattcagtgaaaccttcataccccttaccatcctcaatcttcaggaaaggtagaacggactaatggtcttttaaaaacacacctcaccaagctcagcctccaacttaaaaaggaggactctgtcaaggatagagcccaaaaactcaccaaccaagcaagtaattacgctgaacccccttgggtactctctaattggatgtcctgggtcctcccaattcttagtcctttaatacctgtttttctccttctcttattcagaccttgtgtcttccatttagtttctcatttcatacaaaaccacatccaggctattaccaatcattctatatgacaaatcctccttttaacaaccccacaatatcgcctcttaccacaaaatcttccttctgcttaatcgctcccactctaagttcccacgccacccctaatcccactcgaagcagccctgagaaacattgcccattatctctccatacaacccccaaaattttcaccaccccaacacttcaccactattttgttttatttttcttattaatataagaagacaggaatgtcaggcctctgagcccaagcttgcacatgtacatccagatggcctgaagcaagtgaagaatcacaaaagaagtgaaaatggtcagttcctgccttaactgatgacattaccttgtgaaattccttctcctggctcacgagctccccccactgagcaccttgtgacccctgcccctgcctgccagagaacacccccctttgactgtaattttccactacctacccacatcctatataacagccccaccctatctcccttcactgactctctttttgggctcagcccgcctgcacccaggtgaaataaacagccttgttgctcacacaaagcctgtttggtggtctcttcacacagatgcgtgtgacactgagaaaggaggttaaagatgtctatctatttcataataggaggtaacacactgtgtgtgtcccatgtggcgagagctcaaacaaggcatgtcactgcaagtttcccagaatgctaaataagaacaatggaaaatttataccatttggcactaactcatgggctcttgttcctctgattattgggaaaaattatttcaggttccagatatctagaggtttggtgttagagagttggagatcagcaaggagcaagaaccctctcccacaacccccccagaaaaatgtacaaataaatcatgaaaaaagaaggaagagaggaaagaaaagaagagaaaagcaaagcaaagagaagaacaaatgaaaaatagcaggttaaaaatgaaagatcaagttttgagacagaataaatgttagaaatacgcaggcagaggacagctacttccccattacaggcctcgtgtttgcttctagctttttgttgcttgggcaaatcagcgcaatttaaatggccaaaggatatattgaattaaatgattgcaattttgaaaaagaaaaggtattgtttccacttaaaaaaaataaacaaataagatgatacacttcatcctcttggattaatcagatttggagaagcacttacaatggaatggaagcaagcatagttaaatcacaaaaaattggtataattaaagaagcagcaagaagcacacacagatgtatggatatacagtctcacacaggttgccacccccttagggactattactttgtactaaatgttagtatatagaagaaaaagaaaagactctcaattgttttctaagtgcaaccatttttttatccattttcagtaaccagtatggcttcagtaattcagaaggcaaagggaaactgagtctctcagaagaaactcaagctgttctaatcatggctaatattcaaatattaagaaagcataactatattgcaatgcgataaagtcaatacattccaacttatatggtgctgtaactatttgattcattttttttttaaagcagaatgtactcaactccttgaaagtcatgatctctgagataatctggttgcatagttgcctagcattagcaaatgctttcggcagggaaaaccatttagaggttaacgaattagatttctcagatttatccatggctattatgtgagtaaacggcattagttacaattcttttttatcacaaactatagaaaaagagaggatatattggcttgagtagctggaaagtccagagaatgtcattaattcctggcatagttggatccagaagctcaaacaacatcagaatcaaactgctctcccttgatctctcagttctgctttcatctttcatcttttacaggaatgctctcctttcatggtggccctaccaggtattagattgcactcctttaaccctatgttttaataaaaatattaggataagctctgattggctcgtataatcttttttctaccaatcactgtagtttgcagcaagtgtccaatcacggacaagactgactttcatgcctgtgaaccagagacaaaattggcatgggctgagaacaggtagaaaaactgggatgttggccgggggcagtggctcatgtctgcaatcccagcactttgggaggatgaggtgggaggatcgcttgaggccaggagttcaagaccagcctgagcaacatagtgaaacctttatctccacaaagaaagaaaaggaaaggaaaatcaggaaatcaggatgttgttttcaggtactgttggagaagaatgctgcataaataaaaggaaaacttcaccaaccagtcctgtaaagaaccttgcatcttcagagtcacaaatcatattcaatttggcaagcacacatttttagtgaattgtttagattattaaaacaatgaccaacaaaagccaaaagaatgtaaaatatatcttatgttttaagaacaaaagtcttgtttgagctctcacctcatataacattctcgtatatatactgaccttgtaatcactacagaaggtattttgcctcttctaacacatgttcattatttgtgagtaggtataaaaaaataagaattatgggctaatcattttggtcttttctatgatgctgatatttgattttggttaattatatttattaaataatgtgatttaatatgtaactgccagatgaacacaaataatctagatttctttgcttcaagtaaaggcctaattttactcaccttgtaaaaacatactacttatgccaaaaaatataagaaatattgtttttaggattgttagtattaaattaatccattgtggatggtgaagtagataaggagaaaatacaagtgagtgaagctggttttgcctatttatataaaagcatcatgaaatagttgcagtatcacttaaggtcactggtgacaatcaagccgcaggagcatagttctcccttaaacagcatttatttgtattattcatacttgtcttactattacttagcactgacatcccagtgctttttaacggatttaagatccttctgtgtatttaataaatcaatagaaatactttacagggaaaacactttatacacttaaccattctgaatgatgacacattattccttaagcaactcatttacctttttgtttgtttgtttgttgcctttggttaagaactaaaacatcacttttataaggaaagttgtctttctaaaatatgtcatttttgacatttctgttttcaatgttcagtaaatcaaagttgttttcatatgaaataccaaaataataataaatctctctcagcactccatttctcagcaggaaaactcttagctggttgtctgcaaaaacccagtgaatgaaacagaagagaaatgcaagccttgaaattccattacctccttatggaaaccactgaatcacaattcaatattttctagatctagaaacccaaggttttctgattcgttttcctggtggtggtataacttattgcaaatcagacaagacagtccagcccaaaaaagaaatcatggaatgagttatgtactggctgcaatggggaagtcagaaatgtggagttaagagacaaaaaaaaaaaaaaaaagaaagaaactacctaatttactggttaccaagaaaagtatagaagaagaaaacacagaagttttgtaaaaataacaatgtgctttgcgagagatgcgttctaaatttaaaagtgtaattgaaaatttaagtataattttacaatgacaatgaatagcaagactgtcataatgtatttacagaccagataatcaaaatatataagtgtaattttaccaacaataccaactgtatgcatacatcaattttttctattttcaaaactgaaacaatgttaatgaactagttttactcagagcagtctgacatcaaatacatggtctcttttccaacactacatttccaattctctgacactgcctgggtgacctacaattcaattcaattctgacattatctatttgaaattagcatcagatctcacaagttaagggcaatggctgaacttaaaactgctgagtgaaaaatagaagaaacagactgagattcacaacctatggaatgcatgcaaattaaaacgatgtgagaagagatagagagatagatatcaaatacagtagagtagttgcataatgaatctggggaggaagaagattggagaatagagataaaaagaaatccatctatcaatcaatcaaaggaggcatgtcacatgaaccattgttaatggtgcaccataattaggcatatgattaatataatcttacgtacctgagatctaaaaactaaataaatataatttaaaaatgaagtaaccctatatttaaaaaagaaaaacttttttaaagttcattttgaaagcaaagcaaacggcaacacatttttaaaaagtaggaaaaatgagtgtaacacatataggagagtttatgccacaatatttaaagagttcttgcaaattaataaaggtgtcaatggtgtaaccaaataattcactatcaaaaatgcaaatgttcaccaccataggtaaatgtattcaatatcattaatagactattttccagtcttccttgagaataggtcaaaaataaatttcaaagttatgctttgctaccctttcttggttccagagaaagagaaacttatctgaagctgattgaaaatggttaggatggaaaataaaccacagtcatggagctgggagggacataaaagttcatgtaacatgtgatagaacagaggcactgaaaagccgaataatttatccaataaaacacagaatcacaatgtgagaaacaggattagaacccagtcttcaaatgtcccacagtgaaacatcgaccactggaatcacacagcagaagcagccctcacaagctggacttaggaggccaggagaatcgcgggttgtgactgcttcctgagcatcttccagtcaggtctgcttccagaacgagtcatgttccctctccttcccaccttgtctctctcacattcagaggatcaccctccttgacatttgcctagttaccctcaaataatgctcactttggcatgggaattctttcttggatactgttggcaattccagtattgttataatcaattatttgtggcctccatatgaacattttttccaacccttgtatctgtccatgctcctgttcgcttcccattcctcttgttatttaagcattatttgactcaaggcttggcgcatcacaaacttaggtggaaaaagacactgttagtgggtgtcaggcatttattacaggaaatacattaacatcacaaggaggtgtcattgaaaatattctcaatctatgatttagatttaagactagctaataatgtgctctcctttctatttttaagaaaatagactgatacagactttaacatgaagcccaaccccaacaccagccctaatttttcaaggaaatgaaaaacgaaagaagcaaaatcccaaataacgtctatagaagataaaacagtaaatattgtagtaaacagcaaaattgacctaaagagtacatttaaaaaaatttttatcatagtataaatctgcagattttcaaaccaatttataagtactgcatactgatggccatcaaaaggtattaaatgtcaaggaggaatagagcgctacttcaagaatcgaacttaactaaaggtcaaaaagttttcaatgtgtgcacctttaaaaggttctccacctgcatgtgcatataaaaacagcagaattattcattttatgttttatataaaacagaaaatttcaaaggaactttgtgttttcagggctgcttcaggctctctgcccagatcccggggatgtgcacatacatacattgtcctcttctttaagaagcacttcagaggaaaagtttgagaagcagtggtttatttgaaagaatgataaacttagtgctgggagaactgagaaccaattctagctttgatacttactagctatgtcacctaaactctcaaaacttcagtttccccttctgtaaaatgggattcctgctgcaagatttagaggtgggtaggaggattcaataattagtgcatctgaaaaaaacttggaaagctgataaacaatatttatgtaaaaagtttgatttgagcaagattaagaaacatataataactatggcttatattacccccaaaaagctatatttaaaaaaatttggagatggggtttcacaatgataggtcattgtgatgttaatgtatttcctgtaataaatgcctgacactcacttatagtgttttttcccagctaagtttgggaaacatgttgcccaggctgaactcaaacttctgggctccagggatcctcctacctcagcccactcagtagctgggactacaggcatgctccactgcaccaggccaaagactgctatctaaatattgtacttgcacattgatttttttcatacatcccttgatagtcccagaaatttttattctattttcctgcctcatgagtcactctcccagaaattccctgacagttttgatattcaatcttgcttgagctactggcatttgtaggtgttatgtcatttaaatgactaatacctctgcactattcacaaagcagtttcttttttcttttttcctagtaccttctacatataggtatttaatgaaagcttcctgaataaaataattgtaatgtaatgaaattgagatgtaatgtaaacattggctgaagtctctggtttcagcaatcaggctatctgatcataaaccttgtctctgtcacttactagctctgtattcttagacaaattagctatggctcagattgcctatctagaatatgggcatcacagccatgccgtagtgtttaaaaataataaatatgattgtgtgtggaaagtgctagcatacctttgtcatgtgctaaatatgcaataaatagtaatttttatcaaaatagttgtataagtgggaaagaggaaatggcacaatgctgccaactgttcttggctataaaatatcacatatttctcccatcttctagaactcacagctttgtgatttatacttgttccaatttgaatggaaattatttcctggcaacttgctgctgtgagaatcccagcctttgaccacatgcctgctatgtttactttagtagctctttgttgacctagtcatttaatggccctggatcctgtttcttccccatcagctgtttcactctcttccttccactttcacatgtcttagcgcaatgcaacttcataagtaactctaccttgttatgaaggttcttatgtttagttaatagtcttcaaagatatgtttataaattagtgttttcactttttaaaattatttctattttaagtcaactgctagccaaaaagtttttcgatgagtttagtttgaataattctgtaaagtagctactcgatatttattattgattgctttaaaaatgtttcccatcacctatatacattacaatagacaggcatttattcaacataaaaaagaaactttctgacttcaagatcattagattataaaatgttgacccactcaggcagattatcttctttccttgatgaccttaaaagtcagagaggcattgaaatgatttcaacaatttaaatgctattctgatacacttacaataaatatgtgcaagtttcagcccaggatatagctataatttttaatgcaacgttataaattaagacgaaataggaagattttatatccagaaaaaatgataggatattaataggattttaaacttcctttcttattattttaaagccatatatttaactcaattaaaatcaatagaaaataaaatactttgactcttattctgtttcagttaccagactaggactggaaatggacaaatgacaagtcaggaacctttttctcaagacgttcacagtctatttgagaagacagatatctatgtgtgtgtatacacacacacacacacacacacacacagaaacatatacacccctaaacaataagcatatgcacaagagagaaagtcatcatggagaaatgattgattctctgagacaggtgcagaagtcaaccctaatgataactataatattgggtctgagttttgaagaactaatagaaatatgtcagactgggctagaaggagctttctaaacaaatggaatatgtgatttgatagagtgtaaactgcaagagaggaaaggtgcaagagatagtcaaggtcggatcatgagatacagtatggccccaccgcagagatatcagagaaacaaagcagtaaataaataacaatctctggaaataggaggttagatacaactactgttctgagaaacattgctaaatctgttgctctaaatgtagtgcccgacaaagcatccaagcataggtgatttttttcctccatttacaaaactacagtgcgggagcctaactacttgatacttcactgatgccaaccccgaatatcatagattttatttgagagttagtttcttcctatctgaagaaacaaaaaggcttcttttaattcctgcagatgtgcttgtttctgggatgtctgtaagaatctgccatcagaaaccacaatccagaatttacagttcaaagtatcagatggtaagagtttccataaatttgttctaatcaaaagaaaaccacctggaattaatcacgtgacagggtagcaggaagctgattaaggatgatttgcttcggtagaaaagctttcagaacaattgcagaagttgtagtaggcaaggacagaagggattctgttaaaatttttcttttgctttttctgtcttgcaaaatatccatctttataacataactaggaatcttaattattgcaatgagccataactcaataaatgaacacttttcaccttaaaaaattaacaaagttacaaactaacaagcagaagagaaatattcagtatcgtctgtatctttttcaatttctaataccaccttaccctttttcaggcttgcctccatccttcccaaaatattgaaactgccaaccttgcactgctctattcctaatgtgtgtgtgaactcagtggtttttctatgccttctttcaatttgtcctccccaagactgagcactgtggccctctatcttgaaactcttctcacccctttttctcataagcacggctctttctggacatcttcttatgtttttaccctttctgaacagattctttcactggattccatttatcttctggttccttaaatagaattgtttctttagcttctgtacttcagctacttccctgctgctctgagccttccatgcctgacccacttcctaaatttactcccagaagattaatccctggttttttattttaagctctctttctctctctctctttctcatgagacagaaattacctaccattcatttttagcagccacaaggacatcaaatctcaaaaatgactgcttctggtttctcaaaatgaatatagccagaatttatcttcttatcgtgtatctgaacaggctttgttttcttggaaatccttctgcccactaataggagttcacccacacaagcttgaaatctcagagagcaatttgtgtgttttccatacaatttccttgaaagtctagttttctatttttattaaatcaccttcaaaagcattacctcttccaaattgttcttgctcaaagtcactgtggtaactttcccagatatgatggtctacataagaaaaatactcttaaaactggttttcctgccctaatcctttctcctttataccatcatgcacaataatgatatattgatattttaaagagtaacactaatcatatgtccgaaggctcaaaatgtcaccattttctacaatgtcttagattagcattgaagtcctctcttcgacctaggcaatgttttcaccataagtgtccagtgcttctcactctatacttaatgccaatcatcggagttacttgctgttttgaattgctgttttgaatttagtatctacctttacctacgtttttgctttttgcttccacatttctgcgctttacaacacatctccatacacatctgccatacatccagtaagagtctgttcaaatggagatctggaataaagctgtccatgatgactctaattagatggtagcatttcttcttctgagcactcagaagccattctctgttcccctgtagtagcatatatggcttttctcttaggcagacagggtcatgatgacagggtaattttcatatatgccttagcaattacaggatgaaagaactgaccaatatgtttgaccaatacgtttttctgttctctttttctatggagtctgaaaaatctgtaaagacaatataaagttgcccttgagaattagtatttaccttctagagacatattaaatatttgttctcaataaattagaaaaaggttgtttaggcattaatttatttttgatgtattgaatatctaaaatgtttataatttgttaaagttatattttccttgaatatagattaattattggtcttaggtctaacagagtcaggagcagaagaaaggcattctggtgtatataattttttccttgacctccatatctgctattattccatatcaatttacatagatgaaaagaagaaataaggtaaagaaatacatactgacatctacatgtgtgcatggaatagtgctaaaccttttcacaaactcttagtaaatcattatatgtgggttaagaacatttagacacatttttgcagatgagaaaactcataaaattaactgctatcagatcttgaattcaggtgttctgattcccaatacaaagctcatacccctaaaccattccatctgtagtgagctaatttcctttattccctgattgcaacaaactacaactacttagggttttatctgatataaaattatctcaaaattttcttacacatctaagattttatgacatttattgtaagtctttttttgtgtgtagtgttaccaaaatcagttgcagggataagtttcctaactgcacctccccatgaggggagggcgaaacttattagaaaataaatttctaaaagaaacttatcagaatcttaaaaaggcaggcatgaaagatgtatctggaagctactgagttcctatatgactctggatattttcctctggttgaatagctggtataataagaatttcatccatataaaaggatgaaataacagtaaagctatgtctgaagaatatcagacatttagcaaaaatagaaaaattttatttaatatttaagtttaataataatctgaatgtatgctttacatagcacaccacatctgagaatgtattaaattcttcaattacatcttgatattgaggatatatatacattcttacaaatatgtcatatagatataggcaaagtggtaaaaacatagtatatagctatgtagctgtgcacttatatagatacattgtataaatttaatttttgagggatgtatgttctcatattacaccttttatgattctttgaaagttcacttttatttatcaatacaatttttataaactaacacaattatattcactcaataaattatgtctagatgagcaccaataatgccttatgatttaaacaaagtaactgtttcaaatgagcaacattctttaccaataaaaaacatccaggaagtaaagcaatttacttattttgcataattcacacatgttaactcacacaggtttatattgaactccaagtacagaagacatttttacgtaaaatgatgacttgagcaaatggcatatatttatctattctttatactatatttttataaagcagtgaaggcatttcttagcagtcaaaattctatatgcaataaccttaagctgaatgagtgaatttctggactctaattttaaaggaaataaactctgctgattctagtttgatgatagttttactaatgtcagtgtactgagaacattttctttaatcacctcaaaaatgccttcaaaatatcacttggtggacaaaatgatcaaatgttgcaaataaaaatatgctcaagtcatcaaattgtttgactctcaattatgaaattatattaatcttcaaatgaaatgcataatggttaaagtaacttttcttattattaatatagaaatctttggaaactgtggactagggtcaaatctattaaaaagaaaaaataatagtacttatctttgctgaagccacatttttttcaacttaaaatgcgtaactatttgggtttacatatgcttactcttaggtagaccaaaaaacatttctatccttgaaacaaggtagataggacagggaaagaaatggatacatggatttctctctgtgtgtttgtgtatgtgaggtcaatggtttcacttttttaaaaaagaaagtaaagtcctcttggcctcatttcattattagtgatgtatgcagtctacagaacacacacaaatacaaaaataatatacagtgtcttcaaccaaatgatgttcatctttggtaaccatatatgatagagatatagaaaaatagaaatagtaagtgttttttgtctttaaaacatacagatattgtatgcattatgtaaagcattattctagaatatgtttcattcttaagaaatttttcttttgcttacaaaaatgatttatgtagtgtagaagataaataaaattagggcaatattactatctttcctaaagtttttaaagtctgcctccttaaacttaatttcgtttttactttttggttcattttcctgcttatgaatcaaaaatcttccctatacattttaccatggcattttacttaaattccttagatgcttgggactgagacacttagttcttatcacaaccatgccccccaaaagtgtttaattgctaaatgctaaaatttaagagtgaatattattcttcaacattatatacatgagtgtaattactatgctgaaatataatgaaactctcattatgcccaaatcagctaccaaaaataaaatcattttgcaggatgatgcaggtgcttgtagtgaattatagaaataagcttgaagtttcacagactcttcctctataaaaaataattcatcttttcaattgtcagcactattcagaagaagcccaaatgttatttattccaaaagcctctctctctctctcttctttctcttctccctttctcctctctctctctctccttcatgaatgggggtagagagcagaaagaaaatcaactgctaaagtaaagcatagattattatgacccaacttcagaattattgaacctgagttcaaatgtctttcaactctatttgatagatatgacagtcttctttaaaattttatatactgtactgttttaaagctcaaattttaaagtttgaaaatagtcttatctgatccttgcaaatagtcttgatctgatccttggaaatagtcttatctgatccctttctctctcaactctcaaaattctaaaataatttcacttaaggtttctgaaatatagcataagcaatatgtctgaggaacagaatttattagcaatattagataatgttgctatataattaattaggaaatattaccaaagaaatctaccaaaatattatttactttatttaatatctaaactttcaagtaaaacgtacaaatggtgaacttctgatatgctgtaccttttctttactacatttaaactaacatatttgtcactaaagattcaggtaaaaaaggcacagttcaaaggaaaatgtcttttttattttacacaatgttaagaattgaattttgctcttgcagcttcttgctgtacaattttttatgctctgaaacttatggacaatacttccgtagatcttgtagcaccaacaactgtcaaacatgtcatctcaacagaatgaagaatgtcctcggttagtttacagacgattgccgtatttttacattctttgttgccatacggggctgcctgaaaatggacaactgcatcatagatcattcagttgtgaatccctttttcttatttcagtgaatcaatgactgtcttatatatatattgtataaaatatattttagaaacttttacactgtcctacaaaattaaattcctctactgttctcaaatccctagagaaaataagagactgcatgccaaacaaatcctgtttgctctcagaagtgtcaaatatacatctgtctggctattcacacacctttgttttattctgaattactcaatagtgacagaaaacacacagtgatgggagccacagcacatcactcttgaaactgcaagaaaatttcataagggattttatcttgttttgtactttaaggaagagaaagaactaaatttactactacttaaagaagaaatacacaactctggtatgattgcacatctgttagctggaagggaaactagaaatgtactgattctgtcccttaaattgttgctgtaaacttcccaaagcattaaacaagtttatttatcccagctagtttaattatagtggcttattaaatgggaaatgacagaggagcaaagtgacttttttttttggtactatgaagtctgatttattttcatccacatgtggacagcagccaaaatttagaaaacagtcttattaactaccttctaccatatgttaatcgagtataagggcattactactgtgtattattggttcaattttgtttttctaaatgtgtctatttttaattttttagcttaaacaaaataaaaacatgtattccaggcttgcactaatgactaaatgcattaaaattcctctttctttcaatggtggaaacaaacatagaggcttacactaatgactaaatgagttaaaatccctccttcttttaaagatgaaaatatacacagaatcatgaaaaaaaaaaaaacaaaacaacaaagaaaacttagtccaggaaacccaggacaagtctgagagctaatctcaagggcacttccattagctgaatggcttgtacattcaaagaactggaggaaacatagggaattttgaaaatggtcaatttccactgcaatttttttttttttacctctaaaactccttagctcaatggtaaaattaaaagatatattttttggagtttgtttatgtaaacttccttgaatttctaaaatgtctctttccaatattccgtgagtatagatctaaggtctttttttattctttttctctcactctcttttcctactttcttctctctgttacttccatttttttcttttagtttgttcctgaacttaaaatgtattgacatatcacccactatttacatggtagaaaacagtagtaatcagatttggatcatcaaaacatgctgatatttttgctttaaagtatttgctggctacacacagcctccctaccagaatctcattattgaagaaaaatacattttaaaatatcaggagcaatcactgacccatccatgaaccaggtgctgcttttacctttcaagccaatgtcatgggagatccagagtggtgcatgtgcttattactctctagtcatacaattctttcacttccaaatattttctttcaatgtccccaatcgtttgatagtactttgtgcctgagtattgaaaccctttatgattaagacccctctctttaatgaatacttcagaagacaaagtatgaaacattgtaaatacagaagtcacacatgtatgcaaaataggatttgatactttcaaatgacagttgtcagttagataaatccccatatctttttttcatttttaagtattcattgcacaaatcgaacaccaattatttgcccagaactgaggatatagcagttaagaaaaaaaaaaaatcctccttcatgaaaactgcatcgtgatggtgggagagacaaaaaatatgagaaatactcaaaacaattatgtgttagaaagtgcccaggaaaaattatataagtgaagcaagacagtgagttgagggtgggaaattttagacaaatggataaaagaaagcttcattgagaaggggataaaatcagccctccttatctgcaagttctgcagctgcagattcaaccaactggggaaatacaaaaatacaaataaaaacaatattgtattagataagtactctagaaatgacttagagtatatggaaatatgtgtgtaggttatacgcaaatactacatgttttatatcagggacttgagcatccttaaattttggtatgcacggggtcctggaatcaatccccctgagatgactgtattcaaatatagacctgataaaagtgaatgaacagaccgtgtagacatttgggaaaaagaattccaggcagagagagcagcctctggagttgagtgtgaattggctgtgagaccaaaggtgaccaaagcctagctcatacaaggccttttaaactatgctcagggaattcatttgagggtttagatccaatgactggcatgatctaatatttgttggaataagtattgtagtttagtatagcggttcagagaatggactctggtaccagagagcccaggcttgaatcccacctttgacattatttaactatagagtcccagttgattaacttagccttactgtggctaacccatctcatgggagaccatacttgtatctacttcatggaaatacgataaatattaaatgcgctgatatatacaaagcacatgataaggagtatataagtgtgtgttaaaaaataaagactgagtatatcagttgtgtttgaaatgggctccaagggtcaaggtaaagcagagagacagcaatcaggaagctataaaataatcttttttagaactattgttggcttgcattagaacagtggaactgtgggtggtggaaagaagtggccagtttcggcatatattttgatggtagacccagcagggtttgttcagcttagatgtgagtatgaaagataaagaagagtgaggttacagctcaggctttaggctatgtaattggaaatacgagttgacatttattaaagtggggaaggcaatgagcagaagggacagatttgggtttgagcaagaaatgcttttttaaacattgcatttaaatacttattttttgcaaaatattttgagtagctttgtaaatttgacaagcctgttaaacattcaagtggattcaaagattgggtagatatatgagtctggaattcagggaaaaattctaggctgaaggtatagatttgggacttgtcagcctatttaaaactaagtgaattgatgaggttacagagtgagtacagagcgaggaacagtccaaggactaaattctggggcatcctagaatttagatgatgaggagacaaagatggtacacgcaggaaaagggaaagcaggaggaatgccgtggcttataagccacatgaagaaagtggttcagtgagaaggtttgatcaagggtatatgtgatgctgatggctcaagtaagactgggctaaataacagagaggtcatggttgacttgacacagcaatttctatattgatctgaagacgaattcctgaaatcagtgagttcgatggcagatgtaaggaaaggcgttagaaacaagaatttcaggaaattattttgaggaatatttctacaaatataaaaaagaaatattaactaaagggggaattaaattgtattttatttacataaatatcgccatgattttaaaatatcagaaaacatctggtaaaagattttgttttaattgtgacagtctagaagtaaaaatggaattatttctgtaggtgaaagttgctataatttgtttaactgaccagtggatgactaagtgaatctaggctatctaattaatctaaccaagtatacagagctttaaatatataattatcatttaggcacaaatattttgagatatcttcgtggctaattatttccctctctaggaacaatttccaactgcaacattatacaggtgggttctggcaaccattttttaaaatacatacaaaaggtgcctttgctgcagtggattttatcagaatggacacctaacacaatagagggtagtgagagtctctcttctgttatttggaatttgaattcagggtttgcagtgagtttttctctacaccaagtgtattagtcagggtgagttaggaatacagaaaccatttgatgcatttttaaaacaagggatttaatacaatagattgaatattcaaatattagaggactgaaagaacaaaaaacaaaacccatattatcaacttcacaaaccagataccacctacagagctgagctaactcttgtattagtaactaagaaggaactaccacccataagacttgagttcaccctgaagttaacacccatagacagaagtgaagagatggtgttactggaatttaggagctcagacaaccttatacatcttaagatgatgccatgtggcttcctctgataagagaaggatgggatctagctggaaataacacctattaggggcatacgtgcaaataagggtgctaaaacagtacagaaaatggagccatagtcatttgctgttgccaaagtgaaagtgacagggaacaaaaataaaaatcacttctcctatcttcctgcctttatctcttcctccacagtctaggcaaaaacctggtgccacctaggaagtaagtctgataacacaatttgcagaccccagctttaacatcacagagaagagaaaaaggctgggcttagctctgaaggacaatatgtcaataaccagtaacctgaggattttggggataaacgtccttcacactccatgtggatgaagagaggagacagatgttttcctgcagggagtaagaagaagaaatatgttctttctaagtggggcctgaaaaaaatgaaaatacatttcctattggttttacattttgtgaaatccaatcactgacacccagctgaattcctgctcttggatttcataagttatgtttatagccttaaaattaagtttctcttcatttagtttatctaactgaggcactcagcaaaatatctggcacatattagaggttcaaatagtattcactgaaagagaaattggatcttgttttctgaaactgaccataaactatcctgttccaatattctgtatctctgtgccatctaacagagcaggcactagccacatatgacaactgagcatttcaaatgtggtaacttaggtaccaaatttagtaagtttaaatttaattttaaaaactgatattgaaatcagttattagaaacccttaaatatgtttggaacagctggagatgtgaacccacttttcaaccgtaaatttcatgaaacctacatagatcagatgcttctgacgaagatgcaacattcaaatagagatatatgataaataatacaaaatatttcagtaaaatgtttatgttgattccatgttgaaataataatattttggatattaggttaaagaaaatatattgtcaatattaattttacctattgatttttattttttaatggaactactgaaaatggcatatgtgcttcatattatattcctactggagactgctgctttgaactcttgctactcaaagtatgctcttggaccaagagtatatgcatcacctaggagcttattagaaatgcaaaacctcaggcaccccccagacaaactgaatctgactctgaatttgctttttaacaagatctccaggtgatttgtatgaatattacaatttgaaaagcaccacttcaaactacttttatattcattagttcctctagagcaaagattagatatagtctgtcctgtctgtctcaaaacatagtttggtaatgaaaattaggacatgagagtttggtaaataggaggataatatctattaagcttggaagttgcattaagtaatacacaatttttcccagcaagttaacattatgtatcagatagttatcacaggtaactatcaaactatcgagtagtaacagcaggtagttacagcagattagaaccatgtaccctaacagagctaaactcagcaagttgcctggggatgtagtacttattgtacgatgccatttcactctagattctttgctttgtctcagtgcaccccagtgatttctcttgaaaagatttactggaaagttctccctgaatttgtaaatgtcatggtttgtcttcataatcagcatccttagcccctctttattgcctctctaactgcctggtgagttcttcctgtccactacacagacaaaaatccatccactgagaacatggcattgcagtaaagaaagagtttaattgacaggaggccggccacaccattgcaggagagaaaattattactcaagtcaatctcactgaaggttaccaggttaggagtttttcaaagacagtttggtgagtagcaggctaggtagtggagagtgctgatcggttgagttagagatgaaattacagggagttaaagctgtcctcttgctttgagttggttcctgggtaaaggccacaagacagttggtgagtcagggtgaggccatcaggttgacagaaaggcaaaagcctgaaaagacatctcaaaaggccaatcttgggttctacaattgtgatgttatctgcagaggtaattggggaagctacaaatttcatgacctccagaataatggctggtaattatttacgcctatgtcttagtagaattcagacccctctcatcctcctaaattggttgtcttttattagttttacgagagcagtgtagttttggagaagggccattatcatctaagcaataaatcaaattgcctccaaagttagtttggcccatgcgcaggaatacgcaaagacagtcagcctgtgaggttagaagcaagatagaaccagccaagtcagatctccattactgcaataattttgcaaaggcagtttcacctcttccatcaaggtactttcacattgtttctaaagtcaaatcatatattgatttttgaattcctttatttatcaggactttatggtgtcatttaaatgtcactagcattagaactgttattgtttctgtttgttctctgttgcacaggtcctgaatggtctactttcagccttatttttttcattaagccttacagttattagtatatgactttgtagtatgtactattttacagaaatattatattgggtaagcagaaatagctgcatttactatttttgtaaattgtgactattgaaaagcctgagaaattctcttatgccttctgtttcaatttttaggttaaaggatagcttccaaagaagattgtaaattattggagagacttcgttataagagtaagttatatgagaaatggtgctggaggaattgtttaacactgaaatcggttttcaactgttcttaatttatcatttatattgtgcttaattccaaaaaggatcagaggttgaatacaataaagaacaccgatttaaaagacccattaaaacaactgagtagtaattgaaggggtaaaggggaggaaaaagagaaagtgtaattgtgctagaaaatcttgagtaagagcaagaatcgttcagaaaaaattctgaacagcaagcatatctaagctttctggcaatgagagcaaaacagactagctatcaaaataattaatgtaatatttaaaaatgtaaacttctttatatgaaagacagaaaagctcatttggtatgttattcaaaatcagactttcaaagtaacaaaaaggtattcttcaaaagactacttcttacattaattttcatcaaaagctgagtgttcattatattatagttctgtgatacagctctgagaggaattgatgaaaactttgttgattaaaaaagaaatttaatacctactacatgtaatgcattgagctgagagcaagaggtgtgcatagtgctctggcattcactcaggaaggaagacaggcatcaagcaagcacccagaaaggtaagtttaacattttcaagatgctaccagagaatatatcaagaaattttatcccagactgaagggcaggaaaacttgctggaggaaatgacatttatgctaagacttgaaaaacaagtttgagttctccagactaagggaattatttatgtaaagactctatagtgagaaacaagtccagtatggcttcagggtgatgagcgaagtggactcttgctggaaaggttaaagtagactaaatggaaacgatgtcttagacttagtaagacttcactcttaattgtagggatactaggagggaaatacagagtttctgaagtgggagttactcacagtttttgaatatatattctactagagtagaaagtagattatacggaacttttagtgaataggaagtataagttatgaagctattgaaatggttcaaaaaaggaaaaatggtgagtgagatcagataaagacaatggaacaaagatgagaaaacagaagaaaagggagagaatgaatcggacttgagtgtatttgcatatggaaggtgagggagtgaatcatgaaatctccctgaatctttacttgagaaaaatcatttagtatcattcatatcaaaaccctaattgtggttattgaggtggggaattagatgtacacatgagtcctcaaagttgtttataaaatagtttttttttgcatatattgttattgctggactgtaagatggaggtgggagtattgaatgttggcattagaaatcatttcatagagtcctatacttttgatctctggaaggagagatattgttagtgcgtagaagtacaaacaatatagggtcattttgctctcctggattgctgtcttatgctgactgataaaccatcagtgtgtctgtgcctagactatgctataagatcagatgagttccagtcagaggccctcctgccataaagacatagtaaagaaaaaacaacatacatacatacataaatggaaagaagacagactatgttatttgcttttggtatttaaaaatatgagctgaacggtgtacagatatagaaataaagtaatagaaagatgataaggcatctctcagccaggggtccacatacacatgaacttaccctagaaagtttaaaagaaactcaaatgaagagaatacttgtagacttctggacaaggttgaacagggaaaagtgagatgcctacgctacacaaagcagaaagcagtattgattccgtgggtggaaggaattagagaagaaaatagtgtttttaaatctcactaaggaaatgtacatatatatatatacacacaaatatatattagccagggttcttcagagactgtattagccagtgttcttcagagaaacagaagcaataggaagtgtgtgtttgtgtgtgggtatatgtataaacagatttatttaaataactggcctatgtgattgtacagaattagtgagtctaatatcagatgggctagtctggctggctggagactcaagaaagagatgtaactcaagtccaaaggcagtctgttggaaaccaggatgacccaacattgaagatgaggtctgaaggtattctgctagcagaattcccttgtgcttggggagagctgtcttttcatctatacaggccttcagctgattggatgaggcccacccacattatggagggcaatctgctttcctcaaagtcatccaatttaaatgtaaatttcatccaagaacaatgttacagaaacatctgaaatagcggttagcctcagatatctgggcactgtggtccagctacgttgacacataaggtgagccaccacaagtaggaactgccctacgggaactgtagtcttggagaggcacagcttgcaagatccctgacagtgaagtgaggaagcaatgatccagcctcagttaccactgaatagttagggcaagactacaaagcataggggctaggcctgctgcagagctctgtttcactctgggttctactcaatactttgagccatacaagtaacttgtagatggggtagtggtgagttcagcacatggaaaggacctggcagaaaggtctgctccttgaggtgcagttatttgtctttaatttcagacaagattatacatcatgatgcagaacaccagcccttgtgtgacagaaactacatggcaggctctgaatcatcgtgagtctatcacccactctctcatgtgtctaagcaacttgatattcagaaacttggcatttcttgcgcattagattcattcagcatgaggccatcgacattgatcctggggtatattctgtggaatatcaaggtgagccagacctgtcgagaccacattactagggtgaggagagttgacatagtccaaatcaaagcaatgcagctctaccgattttccttccaagctaaggtaaactccttctttatgttttcagaaattggatttgagaaggatatatttgcctcagtaatagttgcataccagatactatggactgtgttgctttcttcccatacagttacatctgaaatggcagccactttggtttccccatctgactcaacgtaaaatagttcaatgtatttctccaaaaaccatctggcttttacacaggacaaactaccaggtagaacagataagcaactggaatcattattccttcatctttcaagatttcatgatggcatcaatctttgcaaaccctccagagatgcaataccactatggttcactatttgcgcatgctcacttgtgtatgtgtgagtgggtgtgtgggtgtgtgtgtgtgtgtatgttggagggccagtcccataggatttcactcagcatttgctactatagtagtactcacacagtaagccaagaatccaatgtgtatattctataagttaatcttatatctatatatatctatatgtatcttatacctatataatatatctatagcaactacacattcagaaactaggaacaaggtataagttgtgtataaaagcctattggagtccctgggtatttcagattagcttttcttttatcattgctcccccaaagaacccccattttgggcagtgaaacatggtagcaatatctaacagtccctaaaatatgtcagtattaccccttccacagtgcacagtcactgaagaaaatggtcacaggttcctcagacgaagacttagagaaatgtttacactatacttctgtatccacattgcagaaactttatccaggtgacccagcatggcctcattaatgggactcaggtctaagaactggcttaagtttataaaatggataagcttctacaaatttcctctataccaacctgaatcaggattctacccagcagaatcatacagaaaaaagagtaccctaataggctgcttactcctttcattttttgagaacccatgctcaagctgccaccttcaaagctccatgtgggtcaaaacattctcactgctacataatccatgttctctgtggcagtaattgcacccatcttatctctgataattaaacctttgaaatcagagatttcaagtctattgatgaaacatttgaacattcagttgtactcttgaacattttggcttgtataatgtgtgagcaagttgtgcttacaaaatttatcctaacatgacaatttctttaaatttactccttgctttgtattattccaagggaattctggtatgtgaattgtattaaaaataggctataagctctaaccttcaaagagatctcaaaacaaactgttagaggtccctcatttgagctgaaaaattaaattcaaaatccaacattaatacaactctatcaaaaaatttgaaccaacccaaccttaaatagtaactttttcggtttatttgccttggaatccattcctacagttgctcccctggcttgttctgatacaaagtagcgtgtgcttccaattcctttgacatctgtttctcccagaaaacacgttgatgttcccttctgggggactctcattggatcaaaaaccaagggttcacacttgggggttccaagagaaaattaagctccagtgccctaaggaatttgttgtatgtgatgaagtaacttacttcctatccatctataatgggactagctatatacaatccttggggaatttgagaaaatagtcactcacataattttccataaggtttaattctcttgctggaccctggctgagaaagcctgcacatggacactttgaaaggaggggatatctgtcccaggtgaagtcattaaacatctctttgcaatcatcagataggagagaataggtagctatctctggcaacgaagcttcagggatagtaggttgttcacaatcctgttttatctgtctgttcaaatatgcttattccaagcctcaaggttccattctttcccaatcagtgctttaactaacataaaacttgtgaagtcctgtatttaactggttttgcggtattatatttgagatctgatctttaatcacacatgtcctacaaatacaagaaacaataaaggttgttttaaagatcatcatggaagttttcttctaggaatctccacttagcagttcagtgctaggaattcaaggcccactttgttgttttgttgttgtttggtaaaccatccagtgtattcagaggcaacttgtttatataaatgctattactcacagcatttattatctcagctgccatcaggtacaatgggcacttcatctccaaaaactttcccttccacgtcacgatgatgcaggattttttgctccttagctcagcgaggtctgggttcttgtctcacaacaaggaagaaggaggcacatagacactcaaatagtgagtgcagtagaatttactaagtgaaaaggaaagctctcagctaaaggaggggtcctgaaagcaggttgttggttgccccctcacaactgaatacaagggcttttatatatccaacctgaaggggctgagttccttatttgtatagggtgtgaattcctggtagctccacccgcccttccagggtgcacatggacccttagtctgagccactccatattgatttatttcccttactgtgtatgtgttaagaaatggaattttccattgcaggcatgttcaggtgagccccctccccccactctgcaactccccttatctgcacaaaacatctggtgtaagcacttgtggaacaggtagcaggttctctgggggacccttcccttactgtctgcttaaagcaagctggctagctccttctgataagattaatttgaataattaggataataccgcctgcttgggatatcagtgtgaagcatatatttcccaatccagtcccaaatcctatattgaaggattgaaggccacttctagatcagaatactggccattagagtcacacagaatacagagggactgcatacagaattgtgggaagaagtaagggatgaaatcagatcagagttggtaaaatgtagccctaacagattgtcaacagtgtgaatctgttagcacctccaagaataaggaggtaaggaaggaaatagttttgtcagaacccatgagacatgaacatctgagttggttttgcctacagttggctgttttcctagatgtacacagctaagtataaaataaatgcaaaattccatttccaagattctcttccttgattgtctgggcatgtctccctttaaccagaagccaactgagggcagagaaaggaagggaaaggtggacatgagatctggatgatcaggtgaaggataactagcacagtatcatatcaactgtagttactccaatattctagcaatatctttaccatttatgttagtagtaataaaatattcttatatactaattaatatgaaatacaaataaatataagtgaaaccataaaatgtaagcatttagaatataaataagaagtatttataatgtaagtaataaaaatatttaatgtagttgaatacatagagtgttccaggtactttataaatatatgggtgcctaagtaagattttgtctgtcacagtcctcactaaatcttatttggtatcaattcataacattttcagaaaatagagtcccctccgctttaaggtcacacatttgataagtgatggaacaaggactgaaaaccactggatatccaagtcagtgcagggatatagaaaccacctttgagctgttttaattctaatatagacaaaatgaacttgattattcttattttatagattgtgctatcatataaacaaaggtaaaactaaaattctctattcaaggaagaacacagctaatgagcaccacagttagggagagaacctgagtctttggcaccagagggagcctcccttgtgtgcccatttcagatccttcaaacaagctgtctctttgctgcttcccagataattaaactataattgcatgctttaaattaagtttaaatgtatgcttccagtatttctactgaccagtttgtgtacgatcagccttaaagaattatgcaaatatcttgtttaggttccctcggttgcaaattactttttaatttacttaattataaagggcatttgtctcttctaatatgcaataattaggtttaagtgtacaggcaaatgaattgattcttggcaatgcttctatagcatatataattttacattttaagtttaatttatttgcatatttgatgtttatctggtttaatacatgtacatacattgaaacatatgtgtatatatatttatatgtatacatatgtgtccataggtgcatgtgtatgtgtgcataggtctgtgtatatactcaacccatatctgttactaaatgtattaaacattttcttaaaagggaaataccttgggccaccatcagaagtctatgtctaccttatctttttcaggaagcaacagatctatgctgcttcctcaatctctgctgatggcctgtctttgattccctttgagctagacatcacaactgactgcctctgccactgtattgagacatatcatcctctaaatcaaataattactaatttggtctgcacaaatctctgcacatgtgtagagcacataaacactacttcctaggttgatttgtaagagagaactcaggtgtgaaaatagcaatcccgaggcaatggatgatgagcctgagggtggaagcggcgctccctgctcacaccctgtctctgtgcttacctgcactctctgaagtgaggggcccttcaggcagccactagcaaatctgttatgctcatttcctgattgatagagcaaaatgacgacctttttcttcatttaagattaaatctcacctttcctttttttaatatttcaaatatataagaaaaattgtttacaatttatctcacttttataagctcctgatgatgattattaattcaaacatctaaaacacaattaaggtggttctgagaatgaatgtttgactcattcagtctgtctgtccacatttcttcactgagcatgtatgaagttactgggataaattggtgaagaaagagatgaaattgttcccctcgtggagctcataatacagttggggaaaaacaactattgagaaaatgagaggtataacacacaaatgctaaaaattaacatgtgctacagagataaagcagagatggagataagaggcaggtgttgcagcaataaataaggtggtcaggtaagaacttaaccaggaggtgtcattttagtagaaattgaaggagatgagcgagtgagacatttgcatatatgtaggaagagtattttaggcagaggaagcagctagagccgcatccctgcaagagaagcacaccagtgtatttagggacagcaggaaatctccagaaactgagggccataaaacagcaaggaactcacaggacatggggttagagagcaaaagggtgttagatagggatggggcatgtctcgctgggcagatggaagctgaaagagaaactgagcagaagcaataagtgacatgaaaaccagcactggctcaaaagttcttcatccttgattctgcgtaacccgtgaaagcaatgtctgtccctgttttgtgaaaacatatgtggtggagagattagcgtgcctggctcagggtacatcttcaataaatagtcattgactgactgactttgctttattttcattaagtaaaactaaagttgaacataagcagaaagatatttaaaaaatgaaatatgttgtcatattcaaaatatgccaaggtttaagatttcagtagaaatatttgcatcccactgtgaaaattgggcatatgttggtaaaagatcaaacttctattgttatcttatgaaattccaattcttctgcatccccaagacagtttaaatcaaagctgaagcaaatcaccagtgcttccaggtttgtagttataacttggttttttattacaatttaatagtaaattaaatttactattatacaatgtgataatagttccttgttttataatatttgaattcccacaattatgaagtttatgtagggaagaaaaattgtcttaaccagatcatttccactaacaaattaataaaattagtcactaatcacacctcacacaccacttaacactaacatctttgctatgctgtcatggtaatgggaattgtaattagtatattgaaaatacaaattttgaatttcaatgtttctatcttggtctgtgaagacaaaggaagtgttgaaaagaaaaaaaagaattacatttaaagctattgacaatcagtatcttccaatgtgagaccaactgacaattgaagaaaaaaagaaaatgaagccttaaaagaaaatgacaaataacatggctggcattgtggcttatgcctgtaatcctagcacgtgggagacaggaggattgcctgaggccagaagtatgagaccagactggacaacagagtaagaccccagtccctacacaaaatttaaacattagccgagagtggtggtgcacacccatgtagtcctagctactttggatgctaaggtgggaggatcccttgagcccagaggtttgaggctgcggtgagctaggattgtgccaccgcactccagtctgggtaacacagtgagaccctgtctccgaaaataataaaattaaaagacaatgatgtatacatcagagattaatttagaaacttgagaaaattgataaagccttccaatattctttttcaaaaatggcaacctttatgatgatactaaaagtcaaatatgaattaaaacatgccatattatatcatcatacattttacctttatgtaaaacatcacttgagtgactttttgattggtttggcatttggttgaaacaaatcattggtaaaaatgatttaaaatgttctttacaatttttagttttatttctagggaaaaacatacaagccatttgtatattatcttctctaaaatgttagtcttcgttttaagttaaattacttaagaagccgtttttttcctgttctgattattcttactttcagctattaataatttcctgtacattatttagataaaataaatcatttaataatattttattctcaaatataattgtacttttgtcaatcattttctttcacaatgagtgaactattgtttataaaactattgcatatagacctctgattatcccaaggaagggaaaaaaacccttattgagtcccaaagtatattttgccaattattattatatcattaaattaccaaaaaaagaaaacaataaggggcatggatgaggcttagagacttttaagtaacttatagcaatttgtaaagctggtaagaaacaaagtcattatttagactcatggttgtctctcacaaattttcttattttcatcatattaatacatgttcaactggcaactgttttcccttgaaatctatgtcgttttgtgtgtggaaaaagaagtcaaatatttaaatctggttttacaggaatattaagttaagtttttatacttaggataatggattaacatgaaggaatacaagtttactcatatatttcatagccactatgaccaacctcaaaattaatcatagattcataatttgtaattagttttcctttttgtaatatggaaatgtaatggttttgtgtctcaaaagacttgttaaagctcaactaaccaactaagtgacaaatatgttttgagtgttatgtggccacattgtgtctagtactttataatatttttttaaagaaatgcttgttctcaaggaacttacaagaaaattgagaacatacatacatataaaaagttagtaaatataaaatagcgttattcaaggctaactgaattgttaaattatctttcttttactcaaagaaacattgaaattcctttaataaaagtttttgttataaatttaaatgttgtggtaatttatttcttactatcatcttgaaatcttttttttttgccaaagaatactaactaaaaagtaggtttgcttcaaagtttgaactttgacaaatgatagtctttcacagtaagttaaaaaaaaaatagcagctaggttttgttttgattctaaaacaaatatgtctagtcataagagaagaaatgattataccccatggaactatccatatgtccttctggcacttgcaggtttagaaaaacgaatgaaacaaccaataagctaatgaataaaatgtgtaggaaatagcattgcacaatgttgacaaatgtaaatttctacagtcctgactagaaattggcacatgacagagccatcaaaattaagtgccaggagctcagtacaaaaaggcttcaagatgtttaactataggcatatttagttttctaattcagccaaatttctacacatgctggagacttttgtagtagaggaacattcagctgtatgttttgacatccaacttggcatctctgaaagtcaagctctgaaagctacagtacagaaagaaaagctagagatcagattttcatgattttttatgaaagatgtttaatggtcttgatgtgactccagctctaaaatgttactggcagaaaatatcacaaattatccagctttcctttgaaaagccacatggaaactgaagctattttccatatttttctttaattttgtaaatggaaagcttaatgaccccatgctctgcatgactttggcaaacagatgttgatacaaaacaataatgcaaaaataacataaatattaaaccataggttcttgctgtcttgatctgcatctgcatttataaaatgtgtttttaggtgaaaacaaatattaaacacattacaaagaaaaattggttgattttcagtggctggctcaatcgaaattgaactgtttatttctcaaacttattatagactcaataatacttctctatatcacttactatatggtatttaaacttatgaataagtttaatatcatagataaatgtattcataagtttaaatccttatgaataatatggatacacttataaggtatttaaacttaggtatcacaaacataaaatatttaaacttatggataggcacaggcattctttgaaagtatgaaaaccatcatttccttcccttcatatcaataaaaatatagcacacaaaatcagtttctgtttgtgatttttgttgttgtttcttttgtagacatgatgtcttactatgttgcccagactggtctcaaactcctagttccaagtgacctcccacctcagcttcccaaagttctgggatgataggcatgagccatcatgcccagccactgctgtatttttaaacattcagatgtaatctctgctttcttaattacaaatactcttgtcattgatagaatatgacagataaaatatacttgtgattagatgtttgttgccaaaattacaaagtttgtgtgaacatcaactttttcttttttttttccatatcctattggttctccaatacttgtccatattatcactagagagaggtcacatctaaactcttgttattataagccagtgaaggaaactggtaagaaaatatgccttttcaacagtgagatgcaacagttgatgattacatttccataagctcctataaatcctagagaaaaccagttgttttaaaagcatgtttatgaatatccatcagaatattttttaacactatttagggtactatgatgaatataactgatttaaaaccaaaatctatagttgttttgatttctacagttcaatttttatttgctctttattcagaatagtaatggttacaattaaaaatccttatgcatagcttgttaaccataaattcagccttcctttagagatttgtatatactaaaagtacaggataaatgatctgctatgaaatgcttttccttgagagcacgcactgtgtgtgaatcatgataaagaattcagcaccagtggcaccagtgataacaaatgacatgggttgataatattttggagcatttgaaaatttatctttatacattaaatgttaaaaacagaaagcatccattatgtataacaaacacatatggggtatttattcagcttctgattcagttcaatggtttgctttttgggctttgaaattatagaaagaattccggaagaccagcacaattacacgcataactcacgtggctttacattattgtgttatatacatggtgtgtgtatggatttctccacaatgagttttgaaagagcattgaagcatgtgcttagactacttctaagttctaatgtatgagaattgtgaacctagaaaactttcccagtatgaacctctttatcttaatatttataatataagaattattccagatctgcctaccataatctttggaagcaaattctgtttttaaaacatctatttatctttctcctccaccaatatttcacctttcttactcactctatactgttttctgcccttctatttccttcaaaatctctaattctcttggagcttcaggttttgtttctgagaaaattacaagagttgaaattcccagaaaggggttttttgctgttgttgttgtcatttgttttttcgaatgatatctcactatgttgtccagggtggtcttggacttctgggctcaaggaatcctcctgactcagtctcttgagtagctgggattacaggcgtgaaccatcacacctgactagaatgtatttttatatagcattcatgaattttccctttttaataagatagtttatttgaacaagatgactgggttctccagctgtgctgtgtgtttttttgttcattattcattaccatcgaaaaaaggtgtacagcgagatcctaagtacagggcacaccaactgttttctagatgtattagatgatgtaaaagtgagatcctgccaggaatgtatgttattgcatgacactaatatagttagctaaattttttaactatattggaaagagtcatttaggatagcactgctcatcctatattcaaattaacattgcagaccttgagaagatatttttaaaagaaaggaagttatccttcagactgagtaaacctgaagtaaaataggaaatatgtgtgactgccagttttgagagacatgcgaaatacatagttgtttctagtattttccccactaaaaggcaaatgctgatttttgacgaatctacttttctgattggcaactacatgcatcattcttccggtcatgaaatcatgtacctgttcattgtgaggtgtttagaattctgtgaacaatgctagtaggaccactcgtttctaacatgagagaatgtgcctggctgctttggacaccatcttgcttggacatgcacatgtgagcagaggttacctaaattccgttgctggtttcaatatggactcctctctagcacttttctatttaagtaactgaaatttaatgacctagaggaaacagaggcagttgaattaaaagatttgtaactatgcacagtcaattatgacctctgctgttagctatggctcactaaaggctgattattttcatttatatgttctgcaaacactttaacttcagagtaattaaaacctaaacttcaaatttttccggaaaaccaggactctttccaactgtcccattttttaaaactaatggtggcaaaattaaaccacctgtccaaagctaaaagacagttataacttatcaagccctacaaatatgtgttaatgccagccatttttttccataagttaccagcattctccagaatttcatcagcaagaatggagtgagaagtttataagtggtttttcttcactaatctttatcactcccatacatttaatctgcaaattaaagtgtatttgtgtacagtttccatgcataattttttcagtacttataaaataatgtttaaatggtgtgactaagctttatgagatcttgagcctttctagtctataatacctacaaactgcatgtttattttcttcaattccccaatataatccatttttaaaatagttgatttggctcaagcatttttccacaaacaagtcttcatctgagctcctggacttttgtttctaccatctcttctactcttctccatttttcaggatctctttattctttaagatacaggcacacgagcatatttctcacatgaagacttgtaacatacccagtcaattcttccttccctaaataatggcaaaatacatggccctcattatttactaccaacactacaagatagcacatatttttaattttctgaatagtactgatatggtttggttttgttcccacccaaaatctcatcttgaattgtaatctccataatccccgcttatcaagggtgggaccaaggatggaggtaattggatcatgggggcagtttacccactgctgctcttgtgatggtgagcgaatctcaggagatctgatggtttcataagtatctggcatttcccctgcttatgttgcagaattttctcattagttcagctgaaaatggggtccttgtcacacgaccatgaaatattaggcatgcagacacttcaaagggtgagagaaatagaacttattgggcaaaagggggaaaaaagggaaacagggaccctcagcagagcgagagtcctgctagtataggcttcccaccttgcagattgaattccaggttccaccccagaacaggagaggctatccctgctgcaaacaatgcaaactttccgaggctccgctccagtgtgcattcctcccagtgctcagattggttggaggttctctggtcaccctttatacttggttgtctcacttgcactcactcttccctgccgccctgcgaagaaggtcctgcttctccttggccttccaccatgattgtaagtttcctgaagcctccccagcaatgcagaaccatgaatcaattaaacctccttcctttatacattacccagtctcgggcagttctttatagcagcgtgagaacgagctaatacaaatatgtatatttagatgtatttcaaaatacatttaaacaccttgagggtgaaggttgtgttgtgtatttcctttagatgagtatgtggctgaattagcctttcttgcatcactatattagtttgctagggacatcacaacaaagaagcacaaactggatggcttaaaaaccataaaatcatggtctcccagttccagaggctacaagcccaagaacaaggtgttgtcaggtttggttcctgtgagagggaatcaatttcatgcctttctcctagcttctgctggtctgctgccaacctacagcattccttgccctatggaagcatcaccctgaatctacacatggtgttctccttgtgtgcatgtttgtattgaattctcaattttaaaaatatatattattattattttattttgagacagagtttcgctcctgttgtccaggctggagtgcagtggcgcaatctcggctcactgcgacctccgcctcctgggttcaagcagttctcctgcctcagcctcccaagtatctgggattacaagcacccatcaccacgcccagctaatttttatatttttagtagagatgaggttttgccatgttggccaggctggtctcgaactcctgccctcaggtgatccactctccttggcctcccaaagagctgagattataggcatgagccactacgcctagccaattctctttctttataagaacgcaagtcagattaaattaagagcccatcctagcactgtgtgacctcctctaaccttacctaattatatctgcaattactctatcaccagttaatgtaattctgagataccagaagttaggatttcaacatatgaatgagtagcagacacaattcagctcatgacagtagcaaaccatacaaaatttcggggcttaaaacaacaaccatttacttaactagagattctgtgagtcagcagttttggctaggttcagctggatggttctcttggcctcagctgagctcattcattcatctgttcagcagtcagcaacacagctctgttttgggagctggctggctgtcagctggtgaaatgagggcaactgagccacaggtcttcagtcatccaacgagttcacccacaatttttctaatggcaactgagcaaatttttaaaagtaagagcaaaactgtgaaaggccttttgaggtctggcttggaacttccacagtgtcatttctgccaaagcaagccacaaagccagaccaaatccaagggtagggaaaatagattacacctatttcggaaggagctgcagagtcacactatgaaagggcatagagagaaaaaaaaaaatctcagttaattcttgcaaaccttttatcaaataactaaagcctcccacagtcctgtctctgaaaaaatgtcatgcatgatgtaatatgatgttatttctctcttttcaatccagaggtaacatgtaaaactatgataaacttaggcataatatccctaagccatctgaattccaaatatggcctcatttctctggtataatttatacttgtccagtagaaaaaaatggaaatggaaatgaaaaagacctcaggatatagaactaggatgcatcaaagcatgatggtgtaggtataaatgtgtggcagaggaaatcaagaaaagtgagggaaattgcaaaagagaataaaattttaggactctttaaatgtattatgtcaagggataagttaagccctttagattgaatcatgtaacatttttacaacttctgcttctaaagttatagattaactctcttcctcattgtttttattctataaatgaccaggagagaccagagatcagacctgcgccatttccagtcactgaaatttattgtaaattaacttcctctttattgccatttaccaagctcagatgtgaggatgcccaagacccatgactattacatcttcaacataaaaaactaaatatggatttcccccaaaaaaagaccacctcctaaccagaccattataactatgcattgagcctgatagtaaaaaattaaaattctattaaattttcctaagctttgtctatataaacaatctcaaacaactatacttagaaaatgctgacttccattctttaaaatctatacttcccaggtggctgtcctcaatctttacacttaaataaactctttaagggctgggtacagtggcttacacctgtaatgccagcactttgagaggctgaggctggaggaacacttgagctcaggagtttaagaccagcctgggcaacaaagtgagacctcatctctgttaaaatgtttaaaaaaatctagctggacgtggtggcttgcacctgtagccccagatactcaggtagtctgaagtgggaggatcacttgagcccaggaggtcaaggctgtagtaagctttgatcaagccactgcaccccaacctgggcaacagagagagatcctgcccaaataaataaataaatataaataacaggtcatgccactgcactccagcctgggtgacagagtgagaccctatctcaataaataaatgaataaataaatacactctttaagctagattctggcccttttaatgatttttaagttaacagaataaacatcccatggaggcatatctgacagccgattcatgtaaaagaaaaaaagacctataactgattcattaataacaaaatgcctgcagaaaataatgcatttatacagaataatttctttgtaaaatctagaagtggagcctattgccaaaatttcattgtgtttatatagcatgatacaggggagatatgataattctgaaaaacagaaggaaatttcatactcagcagacagggtgatttattaagcttctccatggcctaaattaagtgtttatcaaatccatagtactcctattactgtttctatacctactaaatgatcttctgattatgatgtggccactcaggctctttgctacctggtaggaggatcacttatatgttggcatgggtatctatgggtatacataaaatttatatatctcttgtgatgtgaaatgtgatgttatgatatatacataaagatcaagatagagaggacatacacatagacatagatatatgtatagatatttgtttgtgcaagtcagtgcctaagcagtttattcactctgaggtcacaaatgaagctgaatttctgatcttgggaagcagttgctgaggctctggtccccatcaaatgaaataatcaagtaacagatacctgttagttccaactcagggaaccaacttctctaagtaatggctggctcatctctttttaataaaaaaaaaagtataaaactggcatattatttatcttatgttctttttgaaaaatattaattgaacatttacatattctcttaatgaacattccccaaattaacaccccacattattttaataaaaaatgatgagataacttatatattatataatttgtatgaccatgtacatttattgataaaatgagccccataaattatggtagcgtatatttgctctatgtcaatgttagtctatgattctttttttttttttttttgagacaagacggagtctcactctattgcccaggctggagtgcagtggcgcgatctcagctcactgcaatctctgcctcccaggttcacgccattctcctgcctcagcctcctgagtagctgggactacaggcgcccaccgccacgcccagctaattttctgtaatttcagtagagatggggtttcaccgtgttagccaggatggtctcaatctcctgaccttgtgatccgcccccctcagcctcccaaagtgctggaattataggtgtgagccactgtgcccagccctagtctatgattcttttaatttacttttgccacatgcttttaaatttcacaaaagttggaaatatagaaaggttcaaattttattttgctattcttcagttaatttcaacaacataatgttctgtcaagagacctcaaagatttttctggaggttgaatttagagataatggttacaaggaaatataacccaaagcaataaaatatggccattgattgctgcaaagtgacagctgctggacaagccatgctgactctcaacagagatatattagctttaaaaaaaaaaaaaaaaagcatgagagactgaagtaaagtgacagagtttcccatggagaaaagacctaaaagcactggtgacagcagtcttggttatctgcaaaaagttccaattcttcagggagagatttacagtcctgtatgtttacaaatccacagagagagctgaaactgtgactctgggaataccaaagacgcttgcatactgcatggttatttgcagccaaagaagatggtggtggttattcgttccagagttgtagccaaaggtgctgacttctaactttagccctttatctcacagtcaatactaaatgttaatagtatcattggttccttacaattgtatgtttttgtcttcatgccgtaagtgctaatttgtaattttattgaagacaagaaccacattttgtttatatatttaggctggtggtgtcaataatccaggacttgaaatcaaatagatgtagctggaaatctgggatctgtttctctctcgctctgaccttgagaaagtcgacaagttgtcaagtgatcagtttcctcatatgtaaaataataatcacatcaaaatattatttagataaatatatgaaattatatttgccaaaattattttgcaaaacagtataatgctatagaatcttattacacagcaccaaacatttagtttcctgtaaataataagcagtaaagctagacaaatcactgaaaatgtctttttcccaaaagaagtaactatcttgtgtgaaaccactgctcatcaagtaaatagaagttggtggtgttttcagatagtttatatagtattttagattgtactatggtagttttttcacattaattttctctagtgttgctcatattatttcatgtctttataaatcacttatttgactatgcttttttgtttctgtgttacatatatacttagcactgagccacctgagttccacactgcaataagtatactttctgtactggtatcgatagaaagtattctgtttgtcttctttgtgcaaaaataataataataataacaaaagcatgacagatttttgacaaatttaatggatatgtttgggattaactaatttaaaatatgagctatatggtattcaaaaatttgctttggaagatccgaagggacaccctgttttgaataggtgcaggtgtctattcacaattttgtgcaattataatctacaattctgtataaggtgtcctgggacgtatggcagcatgaatttattttttaacaatagttatctatctgaaacaatgcaggagaacccacctggtttataatatagaatagcattagggaatgcaaacattctcacccacagcatattatttggaactatcaatgacaatagtgtgctagattaatgctatataataatttaactgctcaaaaatgtacaaatgacccatttactacgaagcattaactacccacactattctttcaaaatcatgacattttgtaaggttttataatataaagaatgtatattacatacaaatgctagttaacattttgcattgtatttaaagatgactttggatagagaattctggacgatgtatgagtagaaagcaccagtaatctgtttctccacctagacaacaattgcataggcacaatccgtccaatgcaactattttggaactctggagtctcttgaaggctttcaacatccaagacaagtcttggacagaaaattttggttagtatcaggcaattttagctctgaacgcagtggtcacccatccctcactcatcagccccaggacaggcagtcgtgtatgtgttcctggagtaggttgcacaaacatgtgggagccaggatgggaaaaaagaaatctgttctccaaatatcaggaatatgtgctgtaagtaactgcttctgatcacagaggttcagacacagagatagcaaccactgttgtctcaaccctagcctcctgtgttgtatggctgaagtgacttcccaacaatttaaaaggtcggcatcctttctattctcccttcatttctctctctttctgttttggaaggcagccaaacattgaatactaggacatcaacatacaggggaaactagtagtcatgtcgcatgcccagggaaagccttggcaaacatctgagaagacctcaagtttatacctcaggctgatgctcagcatggagactgactacaacaaaaacaaaacaaagaaatcatcaaactctgaggaggaggaagaatctagttttcagagttaccatattatttgattcaaatatacagttttcaacaacaaaagaaaatcacaaagcaaaaaaaaaaaaaaaaaaagaaaaagaaaaacatggcccatctaaagggaaaaaaaatcaacagaaactatatcaaaaaaagaccttttgatggatctactgggcaaagactttaaaacaagtgccttaaagatactcaaagaactaaaagaagatgtgaagaagaaaatgatgaacacaatggaatataatagagggatagaaaactaataaaaaattcactagagaaattcaaaggctgaattgagcaggtgaaagaaataatcagcaacttaaagataggacaatggaaattattaaatctgagaaatggaaagtaataagattaaagaaaaaaatgaacagaaatttacagacctgtgggacaccatcaaacaaactaattacacaatgtgttagaagagtaaaaaacagaagaggagaaaatattcaagaaataatggccaaaattgatggaaaaaaatgcatatagacattcaggaaactgaataaacatcaactagggtaaacctaaagagacccataccaagagatattataatcaaactattaaaagacaaagagataaatgtaaaagtagcagaggagaagctactcatcacaatacgattgggatccttaataagattatcagcaggtttttcattagaaactttggaggccagaaggcaatgaaccagtacatttaaatttctaaaagaaaaaaaatactgtcaactaagaattctatatctagcaaaactgtttttttaaagtgaaggagaaatgaagacatcctcagataaacaaaacctaagagagatggttatcacaataccctgtttttcaaaaattgctaaaaacaggcctacaatttgaaatacagggacactattcagtaagtcaaggcagtatgaagaaataaagatctcagtaatggtaaatatagatatgtgggcaattattaaaaggtagtattattataacaataatgcataactctactttttgttttctgcataatttaagggactaagtcattaaaattattagtcatatttgaacacatggtgtataaggatgtaactctgtgaccttaatgacaaagggatgggacaaaactgcttaaggaacagagtttttgtcaaaatgtggaatatacatacaatagaatattattcagcttttcaaaggaaacaaaattcggacatcttttacaccacagctgaaatttgaggacataaggctaagtgacataaggtagtcacaaaaagacaaatactgtatgattctacttatgtgagacacttagagtagtcaaaatcatagatacagaatgtagaatggcagcttccaggggctaaagggaggataaaatggaaattattgtttaatgagtatagagtttcagttttgcaagaagaaaagagttatggagatacagtgtattgatgatttcacaacaatgctgatgtatgctatactattgaaatataagcttaaacatgaccaaaatgataaagttgcattgtatgtatcttaccgcaatgaaaacactggaaaaaaaaaactttgaatagacttctgcggagcagcatgaattaaaagcacagatataattctcaatcttttcctaaagcctaaagtagtcttgaagttcatctatattctttgttccatgattaccacagctttttaatttaatttttctaagaatgacatgtaggatttccaaaatactggaaaaaatatatagttttgtgtacattataaatgaaataagcaaatcttttagaacttagccttttttagcatgagtcaatctttcagaatcatattatcaaaaaaatgagtttctattctctgtctggctcttcatgaggccccacctgatataggaagacattgctggtatttatactcataaaatggtttgcatattgattttctatatgcaatgtgcatgagaatggatgttgtgctattagcaatgggtgtatttataaacttgtttttgtttcgttgttgttgctattgagttgttttggtttttttttttttgagatgtttttgaattatatactcagaacatagtttcaaaagagtgttggaagtggtagcagtttcttgtttctaacaaataatgccaccattcatgtccaaagataactgattatcttgagtagcttatttggaaaagtgtttaagataacattacaatataatgtaaatcatagtgatatatatagcatacatcatgaacaaattctacctttactcctctaaaaaagagagagggatagcacaagctactataatttgaatctctccacatactcacctgcaaccttacagtttaacaagaaaactactttaaaatttcccataattaacaactttagcatatctaggagatagagaagactgcagacttccatttctatgtgagtggataaatattttcaggagacctgatggcagagaagaaaattgacaagtgcttcatgaagtaaaggaaagtatgttagtttctaatgctaacaaaaaacagattgcattttctagtttttaattcacactgattatgctttaatctgagagaatctatgaagaattggaatgagaccagctggaccagaatattagctactggtagtagatgctatgatatggaaagattaacattaaaacagtattaattactaataaaagaaggttgtgaaaggaggaagaagaggagaagaaaacataccacttaattattactaataaagcaaaagagagtatccagaaacctgtgcctactcataaattataaaggtattggtttaaaaataatctcttgaacaacaatactttttaaaagtaaaagaaacaaaaagaaacaaggaatgttacctggtaaatgaaatataaaagaatatggcagaactggatgaaatgaattggtcttaagaataaatataaatgtgcttaaggcatatattttaaaagtgtaattaaaaggtgagcttatccaatttaatcaaaagctaaaaaaaaaaaacagaaaaggagaagaaacatgaagacagatacatacaataaaatatgagaaatagaaagagaagaataactatcaaattataaaaaatgataatgaaagaaagcaaagattataactttactttgtaggatttaaggcaaataaatttgaaaggccagatgttgtgaataatagtatcaaaaataattcacaaaatatgaccttatgaaggactggaagtctaaataatccagtgacaataaccaatatagaaaaaaaattcaaagcacctccccaaaaatgacccagcttcagaaattgaaaggaacatgttttttagaaatatgtaccaaaatagagatataggtcaatggaacagaacagagccctcagaaataacgccacatatctacaactatctgatctttgacaaacctgagaaaaacaagcaatggggaaaggattccctatttaataaatggtgctgggaaaactggctagccatatgtagaaagctgaaactggatcccttccttacaccttacacaaaaattaattcaagatggattaaagacttaaatgtgagacctaaaaccataaaaaccctagaagaaaacctaggcattaccattcaggacataggcatgggcaaggagttcatgtctaaaacatcaaaagcattgacagcaaaagccaaaattgacaaatgggatctaattaaactcaagagcttctgcacagcaaaggaaactaccatcagagtgaacaggcaacctacaaaatgggagaaaattttcgcaacctactcatctgacaaagggctaatatccagaatctacaaggaactcaaacaaatttacaagaaaaaaacaaacaaccccatcaaaaagtgggcgaaggacacgaacagacacttctcaaaagaagacatttatgaagccaaaaaacacatgaaaaaatggtcacgatctctggccatcagagaaatgcaaatcaaaaccacaatgagataccatctcacaccagttagaatggcaatcattaaaaagtcaggaaacaacaggtgctggagaggatgtggagaaataggaacacttttacactgttggtgggactgtaaactagtttaacctctgtggaagtcagtgtggtgattcctcagggatctagaactagaaataccatttgacccagccatcccattactgggtatatacccaaaggactataaatcatgctgctataaagacacatgcacacgtatgtttattgcggcactattcacaatagcaaagacttggaaccaacccaaatgtccaacaatgatagagtggattaagaaaaggtggcacatatacaccatggaatactatgcagccatagaaaaggatgagttcctgtcctttgtagggacatggatgaaattggaaatcatcattctcagtaaactatcgcaagaacaaaaaaccaaacaccgcatattctcactcataggtgggaattgaacaatgagaacacatggacacaggaaggggaacatcacactctggggactgttgtggggtggggggagtggggagggatagctttaggagatatacctaatgctaaatgatgagttaatgggtgcagcacaccagcatggcacatgtatacatatgtaactaacctgcacattgtacacatgtaccctaaaacttaaagtataataataaaataaaataaaataaagaaaataaaaaagataaaaaaagaagaaaaaagaaatatcaaaataaaaatttgaaataaatatcagcaaaaacaaataaattagcatgtgaaaaaataatacctcataaccaaatgttataattccctggaatgcaaggatggttgatatcatactacaatttactattactcacttcatgaagatatctaaggacaaaagctatttgatcacattaattgctaaaaaggcccttaacaaatttatcactgatatgttttggctgtgtccccacccaaatctcatcttgaatttgtacatgttgtgggagggacccagtgggaggtaatggaatcgtggaggagggtctttcccatgctgtcctcatgatagtgaataagtctcacaggatctgatggttttaaaaaagggagttcccctgcacaagctctcttctcttgtctgctgccatgtgagacatgcctttcaattttcaccatgatcgtgaggccttactagccacatgaagctgtaagtccagtaaacctctttcttttgtaaattgcccagtcgcgggtatgtttttatcagcagcatgaaaacggactaatacggtaaattggtaccagtagagtaagattctgctgaaaagatacctgaaaatgtggaaccagctttggaactgggtaacaggcagaggttggaacagtttggagggctcagaagaagacaggaaaatgtagtaaaatctggaactcccccagagacttgttgaattgctttgcccaaaatgctgatagtgatacgtacaataaagtccaggctgaggtggtctcagatggaaatgagaaacctgttgggaactggagcaaaggtgactcttgttatgttttagcaaagagactggcagcattttgcccctgccctagagatttgtagaactttgaacttgagagagatgatttagggtatccaggagaagtaatttctaagcatcaaagcattcaagaggtgacttgggtgctgttaaaggcattcacttttataagggaagcagagcttagaagtttggaaaatttgcagcctgacaatgcaatagaaaagaaaatcccattttctgaagagaaattcaagctggctgcagaaatttgcattagtaacaagaagctgaatattaatacccaagacaatggggaacatgcctccagggcatgtcagaggtctttatggcagcccctcccatcacaggcccagaggcctagaagaaaaaagtgatttcatgagcctggctcagggtccccatgctgtatgcagcctaaggacttggtgctctgtgtcccagctgctccagccatggctgaaagaggccaacatagagcttggactgtggcttcagagggtggaagccccaagccttggcagcttccatgtggtgttgagcctatgggggcacagaagtcaagaactgaggtttgggaacctccacctaggtttcagaaaatgtatggaaatgcctatccaggcagaagtttgctgcagggatggggccctcatggacaacttctgctatgtcagtgcaaaagggaaatgtggagtcagagcccccacacacagtccctactggggcaccaactagaggagctgtgagaaggcagccactgttctccagaccccagaatggtagatccactgacagcttgcaccatgcacctggaaaagccacagacactcaatgccagcccatgaaagcagctgggaagaaggctataccctgcaaagccacaggggcagagcttcccaagaccatgggaacccacctcttgcatcaatgtgacccagatgtgagacatggagtcaaaggagatcatttgggagcgttaagatttgactggcctgctggattttggacttgcatgggggctgtggaccctttgttttggccaatttctcccatttggaacagctatatttacccaataactgagcccccattgtatctaggaagtaactaacttgcttttaattttacaggctcatgggcagaagggacttgccttgtctcaaatgagactttggattgtgggttaatgctgaaataagtaaagactttgggggactattgcgaaggcatgattggttctgaaatatgaggacatgatgtttgggaggggctgggtggaatgatatgatttggctgtgtcctcacccaaatctcatcttgaatttccatgtgttgtgggagggacccaatgggagctaattgaattatggggtgggcctttcccatgctgttctcgtgatagtgaataagtcttacgagatctgatggttttaaaaagaggagtttccctgcacaagctcccttctcttgtctgctgccatatgagacgtgcctttcaccttccaccatgattgtgaggcctccccagccatgtggagctgtaagtccaataaaccactttcttttgtaaattgcccagacccaggtatgtctttatcagcagcatgaaaatagattaatacaatcactcatttctgataaagcaataataatatgtaaattgatgtatttttccttagcaaatgttatgccaacctgtttttaaatggggaaacactgtttgcatccttgttaaattagggatgaacaaggtactatctttaccactgttttgtattctgttgaaggaattaaccagcataatcagaaaatagaaaatattgaaatgtttaaaatcgatgctgttgttatctgcagataatataatagtttaaaaccaatgctcacaagtgtctaggagaaaactcaccaataattaaatgaataataaagtaacaggatatgatactgacatatcaaatgagtagctttcacatattaaaacaataactacagatggtattggctttagatggtttgagtgtgcatgaatttcagttgcaatggtctagtaagataacactggtctctttaccaacattgttcaaattagagttgccatggtattattgactctcagaattttactgctagctcttcagtcttcacatcactgcatagataacagatatgcatcacgataaatgaacaatcacatcttttaaagcgattggtcagtgagcatatgttattcaagtgatacataaacagtggagtttgcagttgtattacctccttttctcccacatgatattttacaaaaacgaataatcaaaagaatgaattgaccaacaaaaatgaaaaaaaaaaggaacaaaatgacaatgctcgaagtaaaattcgaattgaacttaagtggagttatagaagaaaatcctgaccctggaatattagccctgctgccattcaagagacactgaatatggggccagagaaacttagtgaggcagaggtcaacataaatgaagaaagtggttgtaactagaaggatgaaggcataccagaggaagtgacactggcaaaaccttcccattaaaggaatgatctggaatatttcatgatgttgaaagtgcaaaggatagtttgaagctgatccatactttgaaagcgatatgacaattcatcaagcatagaaatgattcactctgtttataatctttatgatgaaaagaaaaaagcaagcattgttcaaattatttttaagtttctatgcaaaaagtaaaaaaagaaaaatacaaaagaacaacttcagtcccctataattttttttttttttttttttttttttttttatgaagcctcacttatcttgcctgggctaagacgacaggcacatgacaatatgctctacttagttttctacgcttctaatgtcttaaatcacagtgcattctgtaatattactttcatgattttcccattttcctatacctttataacctagaggaagggaagtttttatgatctgacaaaaatgtttaaagtcaagaataatcatgaatttttccattgataattaggatcactctctgtggtttctgcctgtacagttttaagtactaccatatctgtgcaaagcatgaactgcctgtattcactacaagttctatgtttacatctactcatattaatgaaaaaaagtctgttttgtttatgattgttagctactaagaagatttctcccttgttagcttggttggtgccagtctagaaacaatgctctagtaaaataacactggtctcttcaccaacattgttcgttagagttgtcatggtattattgattatcagaattttactgctagctcttcagtcttcacatcactacataaataacagatatgcatcatgataaatgaacaatcacatcttctaaagttcgtaggtggtcagtgagcatatgttattcaagtgatacgtaaacagtagagtttgcagttgtattgcagttgttactataccctaaacactgacctaacaaaatgttgtaatacatcacttcagctatattgtgatgatagacttttgggaatgtccgaggaaccaataaaaatttattaagtggaatattattatgtgtaataaataaatatcttaactcaatatttattctgattttttaactactttacaaatagccttttggacaatgaaatcttcacctgcccagcatccctttatatctcataggaaaattgtatacagtaaataactgattctatcccatgattagtgcttccaggaatgacaaaagcaagttcttttctttcttccaagtaaaatactttagttcaatattcttccaaaatcagtaacccatgaactaaaataatgctttatttaaagtagtttgtgttttcatatacttatttatattatgcattgccaatgttttaaaatctgtttcacttacaggatatattatgtattgccaatgttataggagacatgcattcgtttcaattactaagcatttatggtacatcaacagatgaccagtcagtattatagatattttacaaatcataagaaaaaattcctgcaggtgattttttatctagtggagtatgcagaactgtagacgacagttacagtagtgtggttttgaggtgtaggattaaatggcttactccataccagtcaagtgttaatttatgcatacaaatcttccattctaccttatggcatttcagatggaaaagtacatcacaaagcatacatgcttcaagatacaatttaatagacaggttgtaaataatgtttgatcttaattattgtactaattatgatagtgaatgaataaagagaaaatattcaaaataaaagagttaaagaatgtatttattaaatttttaattttgacctgcctaaaattcactctaaataggtagagttataaaaactcacagatatgtttaaaagagtttggtgatgatgacccttatgtactgaagtgcaggaaatgattgattgatatatagtaatgtattgatttttaaaatggcactcaatactaatttgattctataatatttaaggaagtttccacttaccctttacaaacaacaaaatatatataacatggaacattatttcattcatggtaataaagtttattttatcaccaagtcaatatagtgtgagattttaatatatttaatgaatctactcccataccttcaatatcttctagaacttactaatattataacagagtttctttaaaaacatctggtttgtaaagcaataaaaagaatacctgtattgattaaatatacagactccagagccacagtgaattgagtttaaatttcagctttccaaggtgtttatttctattactttggcaaattacttaatcttgctgaaagttaatttttctatccatgatactgggaaaataatactctatcatgaacgtaaggcaagaatgaaattaataatttattttaaaagtcagtgaaaactgtggtatctactctatattgtttatgtcgtggctgatgataacaatcagactgctattacaaatctaatgttcctaaaaggattaggttctcaggatttctatgccacataatttcagatacttcccacttcccaccaaagtagcaaaaacacaaataatggtttacaccggagattagcaataccttgtagcttgacaattattcctttattttctcgtgtaacatattgctaacattttattaaaaataagctatgattagatacattcaccagacatttattaatgaatgtaaacttgctttgctaaatttgaaaaataagcattttataaatagtataaaaataagtgctttcttaaactcatgatctgattaatatgcttttgaatatcgaaactcttagtttgatatactggaaagaattttctcatataaataatattacttgtttctttaagcataccaaaatttactctccagctagaatccataaatgatagaagttgggggatctgcttatcttttatgtagcaaatgactaattccactctgtaatttgaacttccagtaacaagaaaagcaagttatgctatttcttcctggtaagttcttcgggtcaacattcttttaaaaatcagtttttcctcaatgaagaaaattgcttctttactatgtacttttctttaaaataatcatctcatataagtaattttgttgccagagttagtgttgtttctcagaactctctttttctagactctgttcgactgacagatattacaactctccctaacattaaaaaagacagattttttaaaatttaaacttacaaaactgttaaattggtgagagaatacttgtgaaatgtttatttaaaaaatgttgttataaatagaaaatagattttttcaaacctgatttaaattatcaaattacttacataaataaataggtaatttacataaaacgtttagtattgttgacaatttgcaacatttcacatgtttgttaagggaaaataaagtgagaaataaaagtgaattcctgtacagatatgcacacggttgtttatagctaaaaggcaaacagcaatgacaaatacacaaatcatagaaggctaagtgagcttcactccaaatctactttcaaagaaaaatgtcattaaaacaaaccaaaactccatatattgagattgcaaactttagctgaaaatcaataagcaacccatatttgcgttactaatactgcaattattttgagtactcattttacataaatggtacgttcaagttgagaggattaatcagtggaattctagtaaatccagtgtagtcagccaaacagtacatagtgagtatctaattccatgatttgcataaatgcccttataaatcaaatatttataattcattgtttaaaaacaaaatagtatccttatagaaacttgattaggaatactgaaagtgttccccccagacttcctgaaaacctgctgtctctcagaagagtgagaacaaatccaccatcatgcctttaaagatggggtacaactctagactccttaataattatagcagtagcaataaagatgacaaccacttacgtttagtgactggtttctatattctaggtacattatatgggatttctcctgttagtcctgacagcagctctgtgatgaggtactactattcttcatcgtccagagagaaatctgaggcccagaatggtgaaataacttgagcaagatcatagagctaggatgccggagagtaagggtcaagacaaattcagcaaaaataagatgtggattaaggtaaaagtacaataactcatttttcctctaaggccggttttcatagcagtggtcccgacggtacaaagaaatcactgttttacaggctatattgtttgccacattcctaggccttttagatatttctttctcttacctactcagggagtgatcagacccaggaagggaaaatgctgactcaccgtaccacagaggaagtgaagctaatttaaatcacaatactttgtctttaaatgcttagactttaaatagagtctccttccagacagtagaaaaggccactcaggccactaaagaaatctgatattcatacatttacttatgaaatcggataagatgcatttgtttaccttgttacactgtgttataccttaaagctagcttaaagtaaaaataatggagaaaagtaagttgaagaacttgctgaaatggagactgaatattcagatgaaatgaaaataaataggaattctgaaataataggtacactgtttcagtgttggctccactcattttaacaactatgcaacaaacactgaacctctcacacaaatagctaatcattaaaaacataccgattcctaagacaaatatacctattgctggtactatggccatggaagaatttctcacaagtttgccaataaagaaaattgtgtggtaaaataaacaactctaaatgtcagtttttgtgagattccacgtaaaattgggataaaaaattccatctcatagatttattaaaggattcaagatggtgaggcatgaaaagcactgagcacaaggcttggagcatactacaagcccaagaaataggagccccaggaacagaaatcaaaataaaacagctccagcattcttcactgttttttatattatattgttatttaaactgatggtgacattcagcaaaagtgattctatgcatccgttatgattgaattcaggcacatgaaaaacgtgatttaacatttttcaatccaaatgttgactgcaataaggcaagatatccataaacatagtcctttttataactctttcacaatgaatcaatatgctataatcattgccaaaatcttatttcataatatccattatatatgctaagatgtcacttctctgactctaattttatcaaaatttttatctaaaaagtcagtatttaaaaaaataagagcactagccattactttttcttgtaaattatgttcttttttgttgttgttgtttgtttgcttatttgtttactgtgcctagtcaagcacaatatggctcaattgacctcttaagtattactcttctgaaccggttagacttttcttaaaattctgtgtgagagtcatgatgctgtctgccataggaggtgaattagaatagatttgaatctgccttaaataaagcatttgtatttttctgtgtgtgatatttactctcaattctcaccatcaaagctactcacagattatgtgcttctgttccaaaaaagaaaaatctaaataaaaagaaacaaaaataaatgttgcttattactacttatcatgcagttagccaccagttgtgtataacttgaaatacattttctcacttattggacatatttttgatatcagtggtgagcttttatgaccatatcggagttgtctgccgtgtgtatgtgtatttctcttttaagggattgcaaatatgtttggatctgcgtagtaatctcagatgtccacagtaaatacagaggtgacatagagttacaaagcttctcaaaccattgtattattaggataattaccctgtgcacagtgcctgactcactggggttctgaagaggtagttaataaattcatgtaagaaagatgaaagaaaagaaaggaaagaaagaaggaagggagggagggaggaaacattttagtacctaccatagcatttgcaaagcataaggggcataaataatatgcttgtttatttcccccaaagagattagatgagcttgtaaatatatatgaaagaataaatagtaaaacaagatagtagaagtcaatcatcaagggctctgaatgctattggacttcagagaaaagagccagaatgctaaatatttcatatatatttgttatttcattatggagtccagtgactcaagcactatcatattcttcactaacatgggttttaagaattgtctggttatctacgcttccaatatttgttacagaatttcaatcacttaactaaatatatactacttggttttgattagcaaatcagaaagtataccaaagactacagttaaatcaaggtgaagctgtctctatgattgaaaatacagatttcactggaaagaagcagctgtgttcctgaggttagagcactttgttgcagaaagaatatcaatggagtgtttatgaaataacaagggaacatcacatcgcaaagagcaatgaaagcctcttttaaaaaaatctgtataataaacatgtctagatggttatggttctggcagatcactacagaggaaatattagaaaaaaatctctactcatacatttttcatgaaatattctgtattatacatcacagctgcaaatctgccatctgaagtttgcagcttcttaatgacaccagcgatttagggcacagggtggagttaggctgacatgtgactgatgaggtggaagtgtgagtctgagggccattgaacacagagaatttcccaatgtatcataattacagaaacacctgtgctgaggaatttgtgctgaatcagagaaaagacatgaaacttaatggtctgcaagatcctttatctcagacccatggctgttgggggtaaaggatacagctgcatttaaaagtgattttaaggcattggtttttatccttctagtagatgatatttccatcatctgaaaatgtttgtctcatttgagaacgggatattggacatcgaaacactgttgaaatgtactaggaacattttctggaaaatgaggcagaaatgtaaggtcacaaactgctgagcttgatgaagcactcaaaactggattattccgagttttgttatctttacaaactccattattgattgaaaaaaattaagtacacatacatattttaagctaagtaacacagcatttaacagtggggtcactcttcaagttagaattctttccccaatgtgctctcaaccatctgttaactctctgggcaggggtagggggagaagttataacagtggtatgccttttacaaaagagttcagaaaagattaatttagatgtagactgtgatttgagaagggtaagaaaggaagatgaaataacaaaatatgatcattaggagggaaatgaaatttactatttataagaaacaatattttttaatcagtgaaaataaagcaagttcagtggataatagtaaatataaaataattcaatatattagaacaaggtatttttagttatattatttatttctctctaaatatttaatctgtgataaaagacgatattctttggataaatactacatctgaagttatttataaaaatgtttcagcaaataatacatattttgggcaatgtctttctttacatgagttatttgacagtcagtccttttttagaatattctagtgtaagaataatgaattcaaaatttaaatacagtatatcatttattatattattatagaagtagcatgtttaccagttaaaaatcaaaatgatagaaaaagaaaatgtgaaaagcaacaaaagttgcccattatatcatcagtcagatatatctgcaattaactggtataaatcctttcagaaaatgtatcatataatattctcaaaagagatacaaaatttaaacaacagtctgctttgtatataaatttaagatcaaatattgattactcttttttattttttagactgagtttcgctcttgttgcccaggctggagtgcaatggtgcaattttggctcactgcaacctccacctcccaggttcaagcgattctcctgcctcagtctcccgagtagctgggattacaggcatgcgccacaatgcccagctaattttgtatttttagtagagacagggtttctccgtgttggtcaagctggtctccaactcccgacctcaggtgattcacccgcctcggcctcccaaagtgctgggattacaggcatgagccaccttgcctggccgatgactctttttcatcttatgtatttattgaataacatgtgtcacagagagtatttgaataaataagagatataaatttattcttaaatttaaatatgaataatattaattacatttacctgtgaacaattaaataggaagattgcatttaaatgagtaggttatctgatcagtagagaggtgaagtaatactgcaaataaaatacagtagcctaaatactatttgtaggagaactaaagaaggtaataagaggacagaactttggtacatgccctcgtctgatcaccatagatccatgagaagcagttctgtgtgcctgttcaggccttgcatattggaacctgatttcttaggttcacattctagctctggcattatctagctgagagaatttggatggggaatatgttatcaattttaagtaaattggaactttagagacatttttttttttccaagacaggttctcactctcttgctcaggctagagtgtgcagtggcaggatcgtggctcactacagcctcagcttccctggctcagtggaacttcccactcagccttctgagtacctaggactacaggtgggcaccaccatacccagctaaatttttgcattttttataagcaacaggattccatcatgctgcccaggttggtttcaaaatcctgggctgaagcgatccacttgcctcggcctcccaaaatactgagattacaagcgttagacactgcacctggcctagagaatgcattgacctctctaaacctcggtttttctatctgtaaaatgaagtcattgaggataaagcaagttattgattgcaaaggagttaaaacatttgcagacacatagtaagcattatgcaaacattatttcaaaatcaatggtttatgttatagtttattttagagatgagaaatttgaagcttagagaacttgatattttctgtcacttaccacagaggactatgaaataaagtcaatttttctgtcaaatattattttctttcctcaagtttaaaataatatatatattctgtatttctcaagtaactaagttattaattaccttacttgtatctctagcatcacaataggaaagacacctaaataaatcacagaatgtgaatttccatgaaatcgatatgcatttttaaattctatatttttcgcaaataatctaccactttgccctaatcctgacctggttggattttgccattttttaaaatttgatatttgttcattagggattatttgggcattgctttttaatttccaaacctttgcattaacatctgctttatcttgattgctaagtgttttgtgatcccttaagttttgcaccagaagacagcacttcacttatctcaccctagttccagccactggaaatggtgaacataaagctggaaggacaaacgggttgacttaaatgggccatattaactgcatgaaaatgtccaggttttatcttaaaagcaatataacgaataagaggtaaatttaataagcttcagtgttcaagtgaaccaaggggctagaggagagccaaacgtgttgccaatgtttctgttgggtcaattggatggagaatagtaccattctctaagagagggaaaacaagaggaagggtaagttaagaggggaaggctcgattatgagttagatgttagactttgaggtgtctttgggaaattcaaatagagatgtacagaaagcagttggaaagcccaaatatatttcaggttcaaatgtgaactctttaagttggcatcatttttatgtagaaaaaaatcacccagcaaagtaaaaacagacaaacaaaaaaagacaagatagataaaggcctcagcaaaatactgagaaaaatagtagatggatctgaaagtttgtcagaaagaaatctgaacagataaagaagaagaatggtgtttaggccaagttggcaacttcattatatcaaattccttaaaaggagagtcaaatagttttggattttcatctgagctctgcaaccgacagtctgtgttacccttattagatgatttcctttgtgtaaggtttggtctcctcaccttgaaactggaaataaaaacagtacatatttgtggcatagctgcaagaattttatgaaatagaaggatgcttaaaacaatatttggcacaaagtaagttctcaagtataagccattaataataacaataattagaaggatcataggctctgaagctagactgtttggtttaaaacccgattctgtcgatagcagaagtgctaccttgaataaattgcctcaattttgctctgtgcctcagtttgctcatcaatgaaacaaacgtaatgatatctaacatatacgcttgttgcaatgatcaaatggagttaatgctcgtaatctacttactacagtgtatgcaataataattgtttataaaacaattttataggcagaacaattttaacttcaatcactgaacgtactttgagtttttttattctttactgttttcctcttttaaaattacattttaaacagattttttgcttattttttgaaaatatttctttttaagggaagctctacatatgaataaattcattgaagatatgaaaagttaaaacaagtataaaacatataagcaatgccttcaaatgcaagccatttttggtaggattatattaacaggcttatcctgaacaattcacagtcttatttatccttagacaagtcagtgcctgcctgccataggaggaatgtcaggataaccaggtgtataaggttacttaagagagtattatggaaacactgtgctatttaggatcaggcaaagagaaactcaaatcctcatttcttaaatgcttgatttggtgacatgggttaagttactcattgtcattgagcttctgttttttgttgttgctgttgttgttgtttgtttgtttttcatctataacaagtactaggagtgtctgtctctgcaagtcacattaataatgaaatgatataacaaaatacctcgcacgtagtaggcttttcaacaattgttagtttctggttgtctgccagttgacagctattcccccagagaaatagacccagtaatactttactttaaattactgcagaaagtagaaggaagacatagcaaaaataaaaccagctacaaatagcacagttaaattccttagtgagaactactcacaaaccaaatttttattacattcagaagccacagtttaaaataaggctggattctgtcatacctaatgatacggtataatcataaaaatgtaataaatactttctaacacaataatatttcttctatacaatgaataccttcataagttttatattttgctaaccatttttatatataccaatcaaatgtaattgaatttaaatgttaggataataatccagatcatagaagttgaacaaaagaccatcagttatagcctgtagaggccaaggaatatctcagatggatatgggaccagaccaggagaaacaaactcaactcaaaaccgatcctcatggagcaggggaatatcctacttggggatacagtgtcatcccagataagagactttgaagtcagaattagttttttttagcaccaagcacattgtgaattctcaaaactgctaaagaagcttggaatatttttgacctaactaatgtgtgtaatcaaataaaacacctgttcacaaatgtgtcaatcttgcctttgctactaagaattatttatgagtgcctttgtgaatcttgattatactttaattaaacatggacacttcctttcaaattttacagtagtgttgaaatcttctgaaaatacagaacattaaccatggcacttttattgtaatatgaggttaggaatgaactgtttttcttgatctagttttgccaaataatacatgaaattatatgaaaaaacatttttttaaatgaaagttatgtaaaaataaatgtgcaatataattatgaatatttggaaaatggtagtaaagtttcctattgctatggtacctagttttgctaaacttttaagtattatatccctacatttaataatgtattgactaaataaattcaatataaattgaatattatattgcaaatataaattaaagcactagaattttaaattggtaagcacagggtttggtttacagagaacaaccaaaaatgtattgactatttgaattcagcatttcctttaaacaatttaacgtatgtgttctttaaaaaagtgagctaaattttaaaaatagcatctggacctattaccagcattaagaaaatatttccttagacaaatgtcttattatccaacaaaaacccaatttttataccattagattacaatctaaaaaattaacactctaactgactaaaatagttaatcatgctttaagaaatctttgggcactgggaatctgtggctcactgattaagtggctaagactaatgattctagaaagcgaaccttggtgaatttaagaaaagaacaatgtaaaaaatgaaaataaaattataagagattattcgagtatcatttttcctttaaatgaatgaaccagaatgaattctggttttatccttaaataaatgaatagcacccaacagtaaatagattgtatataagcatttccaaatttccaaccctctagaactcacattaatatcagaaaatatttttccagtctcaggactacattacctagctaagcaaactaaaaaataaataagtaaatttttttaaatctcagggcattgaggagatactacaagtgatgatggaggtgatctagtacattacttatattttatcttaaaggtaggaaccctatttaaaaagtaacaagattgagaattaaacaatttggtggttgccaagggagccctgttgcttattttagtttttttttttttttttttaaattatctgactcttataactagaagattttggtcacacttattgtaaaatcaaatccacatttccgtcatcatacctgtattagtttttagataaaattgatatttagggaaaagtggaaagctaatatttgtcagttggatagtaacactcttgaacttgctttggaaatttaccactaaattattaatttattgtgatacgttgagtattaatctcaccaggatgtgtagaaagtcgcactacctgagggaaaagttttcaccaccacactacgctttaaagttatatttttaaacttaagatattagctttcagaaatacaaaacatgataatatttttgatcaccaatttgtgacttcaggatcatttgtttttaaagcatggggcacacaagtgaggcaatggcagacaaatattatttttgtttcacagacttctatataactagataggattccggctctggtgtcttaattgggctgatggagttactctctccattgaaaagatctagatatttatcttttagatagatacagttaaactttttttaggctgggcacggtggctcacacctgtaatctcaacactttgggaggccgaggcggtcagatcacaaggtcaggagttcgagaccagcctgaccaacatggtgaaaccccacctctactaaaaatacaaaaattgtctgggcatggtggcatgtgcctgtcatctcagctactcaggaggctgagtcaggagaatcacttgaaccctgggaggcagaggttgcaatgagctgggattccaacactccactccagccagagtgacagagcgagactttggctcaaaaaaaaaaaaaaaatttaaaaacagtttttgcgatcattttaaaatctacttccaattctatataaatctcaagagtctgtgtctttcttgctttttttccatgcatcaaacaagtttatattttccaaataagaaaatgatgtacctaagctttataaatgacatctcccatgtcatcaataaaaatgatgtacatcttattgtggatttatttagcaaacaattcccagaaatcacctttattacagggaataaaacagatgtgtaactccctcttttggatgtcatatttacacaaagaggcaacaatgtactcccaagcataatattaaaaaagcattagtttggtgatgtttcactcaatagatatggtatctagtctaaatatattttaaaatccttcctataaattttttttgtcaaaaatacaaaaggatctttgcatagatacatggaagaaattcccaattcagcctaaatcacatttaagaagttataactaacatccccaaacaacaaaataagaataatgatcaaatttaatctctctgtcttgtacctactttttgtaaactagtccagtgtctgaaattagccaggacataaatactatatgtcctgatcaaacaaagcctgatattccttttctacttcaattaaacacagtatatttctttctggagcttgaagagggacaaggctcaaattactgtgaattcctccagtcctgtttcttcagagtgctactttgaaggtcaatgccagttgtttgttctaatctgagtattaaaaaaaaaaattgtttacttcaacatagctaagagatgtatctatgaatgaatgatgtattatcaagactggaaagtattattaaatttactccaaggctgatctctttgattccttgaagtcttctcaccagtccaagtgtaattctataattcatgtaattatttctaatttcttaatggaaagataacggtgtttagtgtgttctcagatgaaacaaataaataaatgtaaatatgtgtaatacatatcagtgggagaatatatatgaaatacacgtacacacacacacacacacacacacacacatatatatatgactatgcttcttctattgttcagcatttagctgccttcattatgctcctattacatgtgtcccatcatgtaaaacataagaatttgcaactggcaaagacatggaagaaggaagttaatagcagcatgctataaaataaaagtcatcaaaaataatagagaataaagtatgaaaaaaatatgatttatttaaagagaaagtggcagtatcctttcattttatgcatttcatgaaaagataaaactaatatatgtagtttaggaggagaatatttacttctagttattatgtagcagatctaaatagactagatacacacatgtgtgtgtattaaaaatggtattgacatggacaggagacagggaaatattgggtagaagagggctatccctggcaagggccacaccctcaaacctggacctgtgacctaaagtgaaaacatgcattcctgttttcctgcccaaatgttgcctttttcaaaatcaccctcacctgccccaccccccatcctgtacccaaaaaaaccccaggctccactggaagagtggcagagtggcacagcagcagagaaggagagaagaacagccagaagtcaaagagaatcacctttactacagagaaatggcttgatggtgggacctcaggaagagtttggccagggagagctgaactccaagggaagaccacttttccactccatcccatttccagctccccaccccactgagagccacttccaccactcaataaaatcctccacatccaccacccttcaattcatgcacgtaacctgattcttcctggacaccagacaaggacccaggtgcaggtgcaagaaattgtcacactgaccctccacagagctgtttagcacttaagccaactatggatggcaaagctaaaagaacacagtgtaacacatgccctctgagactctgagggtcatgggaaacccctagatgcttccatgggcccacacagagttctgcttctgctggttgcgcagaagctcttgtcccggcctctacacccaatcacctgagtggtccccttcccacaggggttgagagctgcaagctgagtaaatgagacaaaccccttcacgagtcccacaaaagggtcaagggaactatcccatttcagtattttacttttaaaataaattcaacttcttgttacattattacagtaacttagcacttatttgctaagcgcattacaacgttagtgtgttaagaataaaaactaattggccgggcgcagtggctcacacctgtaatcccagcactttgggaggccaagggcagatcacctgaggtcaggagtttgagaccagcctggccaacatggcgaaacctcttctgtactaaaaacacaaaacttagccaggcacagtggcaggtgcctgtaatcccagctacttgggaggctaaggcaggagaatcacttgaacccaggaggcggaggtttcagtgagctgagatcccaccattgctcttcagcctgggcaacagagtgagacttcatctcaaaaaaaaaaaaaaaaaaaaaagaaaactaattgtgggttttaccctctcaaatggttccaaagctgcacagattataaacctatagatttgaactgcatagattatctatgcagctgatatataaaaatcaatcatgtcctctagtagaatagtagaacagacatttccttttatggaggaatttctattgtattattttaaaaataattcaagtatgattaattttaattcataaatatggaacaatcacttaaatagtcaacagggaatttctggtcctcagcttgattattttcacaattatgtaaacaaaacattaagggcagtgggaagcaggaataaagtggggatggttaatgggtacaaaaaacagtacgaaggaattagatctagtgttctgtagcacaaacataatttattgtagatttcaaaataactaaaacagtggagttggaatgttcctaacacaaggaaattataaatgcttgaggtgatgaatgccctcagttatctcaatttgatcattacaaaatgttatctcattttccaccaactcaagcttcctcggtgtgctccctccacttctgtacatcctttcctgtatccaaatgatttacacagacttccccccatgctctcactgtttcctggaaataactttattattaaatagatctcaccattgtcatcctttatttgtgttcctccacactttgagatgacttatggtcattatcatatcctctggtgtccagcacactctgacacacagctagtaagccaccaataaataaatggttgcagctttttaaaaatcagtgaaatacagacagaaatacagcaagagcttcagagggggcagccacctgacataacactgggtgagtttcctgcaatgagtggatgatattaagcagtagtaaatcaataactgcatgaaaacaaccagccttcaataggctcttctgtaataatattgtctaccaggtgtgtacacagattttgtgactgctgaagcttatataatgggggagtggactctttaagaataatcatccacaattatgaataggagaaccccaaggccttcccaggaagggttcctgcaagggtccctaaagcctaagctttgtaatttcatataatctgctccaggtatgggtcaggtttccaaagagggtgggtgttttgctatagttgtactagaaacagtttacttccagtggaatgtatgatcctaactggagagatttgaaggcaaatatgaataagcaagacaaacagaaaggaaataatctgaagaaagcttcaattcttaaatatagtagtgaatggaaagaaaaggatctgaaaggaagcttaatgtagcttgagaaaaaaatttcctactcattatctgtgtaacctgaggcaatttaattaacctctcccggcctttattaacacaattacgatgtcaaataacacatagcattttctgtgccaagtactattctaatcacattctaacatacagtaatacatgtaacttccacagaataattacactattttacccccattttacaaccgaagaaactgaggcatgtggacttaagtcatttgctgatatgtacacccagtaagtgtcagaatccagattcaaacccaggtttcttctccagagcccgcttccccacacacacaaccaccttcatccgtaaaagcgggggagagctaagatgagttacagtcatgggcaatgttaactttgtgcattctagtttctccctcaggtgtggatccctaggaacagagtcagaaacaatgattcaggagcacatggtttattaagtgcactttcttcagggaaaatctgtgagacggtgaggaaggtcagctggatgaagggatagagcaaaggtgcgggctcaggtcccaggctaagtgtagccttcccctgaaccataggcagctctggaccacagattatcctcacagaattaactgcccctcccaacccacctctgcgcctctgggcaagggagaaaggcttgctttcctgtatttttttttttttaaacagcctcatcagaacatcataggcttaggttggctacctggtccaggagcaatagaagagcagagtctgcaatctcccagcacaagtctcttgagaatgtgggcagtgaatttttactacccaacgctcatggcacctggaagaaggggatctgggtggattctcatggcctctaaaacagttcttaatgcatgatggttactcaataaacagtcatgtgccgcagagcaacatcttgataaacagacctcatgtatgttggtgtttcaaaagactataaagaagctgccctatacaggtctactatttttatcttttatatagtacctttactgtatcttttctatatttagatacaccaatacttatcatcttgttcaaattttctgcagtattcagctcagtaacatgctatagaggattgtagcctagcagaaacaggctgtaccatatagtccaggtgtgtggcaggctgtactgtctaggtttgtctaagtacacactatgaagttcccacaacaaaactgccaaatgacgcatttctcataactcatccccattgttaagtgacatgtgaccgtattggtatcatttattggtcatatttgttagagagtaaaaggagaagcaaaatcctatgttttcagttttggctgaatatgttacaatgtcgaataaacacaaagattaatcaaattgaagattttagccaatattgagtggagagggctatgcatgatatgttcccaaagatattaagatgtacaaattacagtgggtattctggttgcctaaacataggatggatactaatgatcttaatgcatagattttggagtttgttagtttattctctaccagttcactgcatttaaataaggtgataaaagcactatggctttcatataaaacatcctagatatgctttagttacaacacaaaaaaatcagtaggtgatttaggttcgtaaactaggaaagaaggaagagataatagtttaccaaatatctgtccaccaatcagtcaaaaaagtaaattggacagagctttgagtctcctaaagaatagatggtcataggcatttttttagagtgacataaatacttctgactaaagagtaagactcctccaagctctgttgaagctgatatattctctagtgcatccacgagatgtagctattatacataaaagagtaggtacagggtaagacgtatttttatgtctctacctaggacaaagagtcaagggaaatcaaactgatgaatagttagtggatatagaaaagactcaaaggcaatgcttagatgtggtagctccatctaacagagtgctggtatttgcggcttgccatttgagaggccagtgggtggccctggacagcagttgataggaaaggtagagagaatattgcccactgctctcatgataacagcccaggttttctgatgcacaagaccataatccaataactacagtacttgaaaccacaggaaaattgcaagctatcagctctaatgaccaaaagagtataaaaacaaattaatcagatctttctagttgaaattcaggtcaggggtaaactttttttttatgtgctgaattcataaaatatccatttttatgttatttcacttcttaaaagcatactaattgataactcactgattgcaatttttataacttaaacacctcatgcattcaaaatgggcacagactcagtgaaattactcactcccactcaataaaaaattctgtcaaagtttctgaatattttacaacagaattaaaataaaaatccagaacacaactcacccttcacattttagaattaacctaattagtaccagggggagcaccttacttttttgactgattggcgaacagatatttggtgaactattatctcttccttcctaggaccagggggaacaccctagaagtcaaaccactttcaatgttttgtttttagaaattgatttatgtctgtatgagaccagaatattagttaattgaaaaagaataaataaattacatttaatagggaatcttcctttttaatatttttttaacctactggaataaagattatgtccagacattttcaggagattccacaataaattcaaaatattcggttttttatgtatcacaaaatccatctccctgttgaatattatcaataattaaagattcaattgaattctgagaagttaaaaaaataacaaatgccgacgtatacataatagttgatcttaggtgaatgcattgttaagaggaaattagcaaatttattggacaaattaaagttaacagtttaattgagcaaagaatgatttgctaatcaggcagcccctgaaccagaatagggtcagaggctctagtgctaccatatagcagaagaaaatttaggacagaaaaacggaagtgacatacagaaaatagaagtgaagttcagaaagagccagactgactacagcctggcatttgccgtatttaaagatggctttaacacttggccacctttggctaaaactcgatgattggcacaaggctatgtacagcctgtttacacatccggttacattagagttcactatatacagagaaacctttaaaatatgcaaagaggcagctttagaccaaacttaatgtagcacatctgaataaatacatgtggtttggtaaaccactagagctctcattttatatccttgcaactcaagagaccatgtagctttcaaatgttaatattcctcagtgttgactaagggaatcttaactctgtgcattcagaacctgtaatactctttgaacatttgctatgtgtttcgccttttggcaggtgtgggatattaaaaaaaaaaatccaggcacttgaaataagaaatctataaatgtattggagagagaaacacatagcgttaacaaaagaccatgagatctgcagaagaaaaagggaaagatttcttttcttttttggggggtggggtggggtaggggagagagtctcactttgtcaccaggctagaatgcagtggcgcaatctccgttcactgcaacctctgcctccctggttcaagcaattctcctgcctcagccccccagtagctgggattacaggcacacgccaccacaccaagctaatttttgtatttttagtagagacagggtttcaccatgttggccaggatagtctcgatctcctgacctcgtgatccacctgcctaggactcccaaagtgctgggattacaggcgtgagccaccgcgcccagccagagagctttattttctataagcaatcttcagactagggagacaaagccttctgcacaagccaaaaatgtgctccaaggaggggttagggagagttagggattagaaaggcaaaaactgtagggcagggcggggaatcagaggagagaggaagagagttttttggtgggttttcttgttgttgttgtttgtttgtttgtttttgaggcagggtcttgctctgtcacccaggctggagtgcagtggcacaatcacagctcactgtagcctcgacctcttgggctcaagcgatcctccctcttcattttttttttttttttttttttggagagatgagatttcactatgttacccaggctggtctccagcccctgggctcaagcaattctcccaccttgaactcccaaagtgcttgataataagcatgagccactgtgcctctggtccacagtcttgattagattatctttaagcctttaagccccaaatcgccagtctcttttaattggctggtttcaggtagttggtgggttggcacaaggctgcccattgatggtcagtaggggcatttcccgctgcagtctatttcagcactgacaacaggaactgatttggcttggttgtataaagggaggtgctgtgacacttttagaacatctttttgagaatgtagagtacttgactgctccctcatccagtcatggctgcctgatccagtttaacttcgagcacctcagctagccacggggagtccatttttttctgttggctggggtcacactttaacaatgaaattatgcagcagcttaaaacaaacgataaagtgtgtcacaaaaagaaataccctgtaaattaagatgatgtggggaaaaacgaaggaatggtcaagatgatttcttgaaataagtaaaatttaaggtaggactgaaggattaattcttagtaagagtaactgttgactgttgatgtaatcatttaagggagatgggaccaacaaggtcaaaattcccactgattaatttcagaacaaaatgagtttcagtaacaaaaatttcaaaagcaagattaaaaaaaaaaagccaaaagagcaattatatttgtaatgaagtagtgttcaatacaaattgagaatttataaaaacttagattaatttttcgtaaaacaaaaaccctatttattgacaaataatgttaaataatttcctttttaagaaatgctttctatgatattacacattatatgtatcagagatcatgcctcactctcctacaattaaatcaataagtcctaggatttctctacattccacactatgtggcagatggttattgcttgacatatatctgttaagtagataacttaatgaacaatacagtacaattttggtttacagatcaaagtctcctttttctaagactacccaccgagtaaatcctgcattgatgttctgttacttgaatcatacggcaattatatgggaagcgtactaacatattttctttgcctaatttgaagaataaatgacttttcaaaagtgcataaataaaaatgtgatacatttgtgtgcaaatgcatatatacacatataagtatatataaaactatcaagtctccatgatcactgcactacgatcaagttcttcagagaagcggaaccaacaggatgcctgccaaaaaacacacagacacaccatatatataaactgaggaattggctcgtgtgataagggaggctgagaaatatcatggtctatgatacgctgcctgcaagctaaagacccaggaaagccagtgctgcattccagctcaaatcagaaggcctgaggaccaggggaaccaatagtgcaaatcccaattcaagggaaagagaagaccaattttgtaggttaagcaacaggcgggaagaaaatgtcatgaattcatccttcatcctttctctgccttttcttctatccaggccctcagtgaattggatgaggccacccgcaatggagaccgcgatatgctttactgagtccaccaattgaaatgctagtctcatccagaaacaccctcacagacatggcaagaaataatgtttaacgtgggcaccctctggcacagtgaaattgacagataaacgtcacaaatccagcccttgtcaacttggcaacaataaatatctccttaaattatacttaatcttcacatgaagacaataaacaggtcataatttctcctaatactttgttccatgtacaacagaaaatgcactgtcttctccagaagatgttatgaagcacttgagtgatgtttactgctctcctttatattctgtacttaatttctgtgatgtaaaatcaacagtatttaaatactgatgtaaagccaatatacctaatactggatgataacgtaagtaaaggaataagagagaaaacacacacacacacacaaacacccacacacacacacacaaaaccatttccagaaaataaggaagtactcatgacaattacagatcattcaccccatccatcacagtaactcccttgtttgatgcagaggttgcagtgagccaagatcacgccacggcactccagcctggatgacagagcgagactccatctcacaaacaaacaaacaaacaaaaacaacacctcccttgtttgcctgttgattcagaggcatgaggagcccatatggttgggagataatcttaacttctagtttaatagaatcactgctctgtctcttgatggaaatatttctttctctagaaacaagacctctaggccagcagaccataatagcatgggaacaggaagcaaaaattttgttcatgggtactagagataattctgggtagaaccactcccatttgcactccctggtttctggacaaatgaatcttggctatgggagaaatagtaacatataacggatactaattcagagcgtatgaagccttctggagaacttccaccagccctgcaaagtattgtcacctagctggcactgtaactgaatcttcaaaaggccattgcactgttctatcaggttggtaaagaatatggtaaggccagtgaactctgtgagcatggcttcattgatactcttttgctgtgttgtgagttctctggcagaagcaatattggatggagtactctgattttgcaggaggcattctgtaagtccacagatagtagtttcaacagaagcaatgcattcagggaaggcaaatctgcatccagagtaagtgtttatgtgtttatgccagtaaggacaaagcattgcacattccatgatggaagaagctcattgtatccaacctgcctccagggagctggctgattgcccctgggagtaatgccttttcaggggctcagtgtttgtctctgctgctggaagactggacactcagtagcagctttagccaggtcagctttggagagtggaagaccgtgttgctgagcccatgtaaaaaccttaatccctgccacagtggccacactgttcatcagctcaccgtgcaatgcctgggtggctatggaaggaggctggctggtatccccagaactgggcatcctagtcactttattgttaaaaatccacctctgctaaggtcactgcatgggacacaaatatctatgtgttttccgtctagtcagtttttttgtccatccacatgtctctcccccaaatttccttgtcaacaattttctgatcatgttccttccaagtctctgactatccagccaaatgattggcctcaggccaccaattggtaattatccacatttggccatttctccttccaagtaaagtgaacactcagctgcgctccttgtatttttgcatacagggagtatttccctttatccatgttatttagggatgtcccagcaaggggctgtggtgttgcagctgtccactttcggctggggaactgcatataacgcagtgccatctggaagccagtcccaagtcttttctttctctgtaaactgatcatagggaggtccccaggaggccgtgggtgcaggctgggagagagaaagcagtgaagcaggggaaaaggagctatgggcatttggaccacttctttatgtaatttctttgagtttctaaggcctgcttggacccaatcacatacataccactttcacttaatagcggagtgctgctgtgcatacctaactttatggctcaatgtgccagataatatccagttgataatgaataattttgtggtccatggttaagtaccaatctctactaagactcagaagcgggtcaagagacatttctcaataggagagtagttatcagcatggctttactaaaatatcctaatcttaaaatctgttttgtggtatgatcacagctcactgcaacctcgaaacttctgggctttagtcatcctctcacctcagcctcccaagtaacaagggctacaggtgcacgccaccatgcccagctaattttgtaaatcttttgtagatatgaggtcttcctattttgctcaggctagtctcacactcgtggcttccaatgatcttccactcctggcctcccaagtctctgggattagcagtataagccaccacacccagcctctgtgtcagcactttttctaattccacaatctgtaacattaaatgcagaatctctacttactgagcctcctttcaataaatcagcctgattcaactctgttctccttccaccatgatcctacacccttcgtgttggttcccaaacatgtttcctggatttctgtctgtataaactagaaaactcaagcaattcttttgtagtgtaacacacctctttatgtgtcacacattgtatctcatcttaagaggcctgctgagacttgagtctagttatagatcgacatgcaaaaaggagtggttggagtgggacctgaagagaatcagtgttgtcttgcacggcaacttccttaggcaatgcagggttaatccctcagatgaaaacagaatgtctgataccactctggatgtaaaagctggtatcactggaggtagggaggcctggcaaagaagactcattagaatttaagggttcaacagttcccaactttatcaaggtcttcccacatttccttagtccaattgtcaaggtcgtgtgtgtgtgtgtgtgtgtgtgtgtgtgtgtgtgtgtgtgttttcctaatcaacataaaggatgctcactttaacagtaggcaccctccaaagctagaaattcaacttgcattttaattcagccaatcacagatgaaatttggtgtttaattttcagcaatttgagtcttgtgctacagaaaataaaggtctctttcaggacacacatagaagagcttaggttatttatatggtgggaaatcacaccggttatttaagctgggaaatcaaatccctgagttgatccttttcttgcactattctgtccagggacattaatagcaaccagccaatgttattacattcattaattttccagaaatgttaaagatgtcatatacagaggcagtcaactccttatttcatataagcgtttgagtaggagtaacatatgtagatattttgtgtgtctctatcatgaaatctaatcagattaaagaacccatttcagaaacccaggaacaaattcagaaaactcatctttgaacttctattcttctaaaaccactctcagtgccaaaatctgcattagtcagtattctccagaaaaacagagccaataggatatctataaatccatatatctagatatatttttatatgtgtaatatttacacagagggagacagagagagtgagattgagagagagatgatgagaaattgacccacgtgattatggaggctgagacgtcccaccatttactgtcttcaaactggagaatcaggaaagccaatggcataattccagtctgagtctgagcacttgaaaactaggggagatgacagtgtaaatcccagtccaggggaaaggctatcatttcatcttaagcaggaaggcagaagaaaaaggggcaagtttgcccttcctatgtcttttgatctattcaggctttcaacatgcccgctgacacccacccatattgaggagggctatctactttagtgagttcaccaattcaaacgatgaattcatttgaaaacactctcacagacactggaaaataatgtttaatctgggcaccctggcatgcagtcaagttgacacataaaatcagctatcactcacacctgtaatcccagcgctttgggaggctgaggcgggcggatcacgaggtcaggagatcgagaccatcctggctaacacggtgaaaccccaactctactaaaataaataaataaataaataaatacaaaaaaattagctgggcgtggtggcaggtgcctgtagtcccagcttctctggaggctgaggcaggagaatggcatgaacctggaaggtggagcttgcagtgagccaagatcatgccactgcactccagcctgggcgacagagtgagactctgtctcaaaaaaaaaaaaaaagtcagctatcattcacctgtgtaagtcaaataagaatgcgggcacaagtcagtctagtgagtccccacagccaggagatcaacaaccttgggagatcagtaacctcctctggccgacaaggcggcacaggcttcccattttcccaaatcctcactcgaggattacatagattcagatgacagagtctgaatgagtgagactcgcatcagaccccaagaatgaatgtgggttcctcatcctcatctgaaccaggaagtactttataaattcagccttataaacttagtatatgactatggagggccaaacaatacagaacatgtagccacaaatgcggccctcccttatcactctccacctctccagattaacacagtctggtctgagtgctttcctgaacccagagctgctgaacggaacaaaggccagttacccagaggtcccggaacatcatgctaaccagccttagcacagctgtaagatttaacctgcactattgaaacaaatcaaatagcacaagggagaatttgagggcattgttggagcaacaatgatggcataaacattcttaaactcgcttctttagagataaactgtaaattagagctaattccaagaactgtgacataattccacattgggaattagagcaaatgacgtatagctcccttctaataaaatatttctgaaaaataaataacaaagtcagcagacattctaagtacatataggaaccacaaaatacaatacttgcttatatcacatcagctatgaaagagattaaaaaatacaaatctttggactcatgtatatttgttcatattaaaatctgcatttctaaagaaaaatataaatgtattgggcaaaacaaaaataaaacaaaatttgaaaacaacaacaaatttccgaaactatggcagaaatttaaaaagagtttaattcccaatcacatagttatcattgtgaatgtgagactcacactacgtcagtgcctctgaaaatgtagtcagtagactgttgctgtagtgcgacagaacatggacagaaattgagaatgatcatgtggaaacttccaatgcaatttgaccttttgatgatctctgagcatgtgatttcatacattaccaaaatattagactgtaaagaattgggaaaaaaaatgccttatcacagatattttgagaaacactgctcaagattatttcttccaaagacatttgttctcatgtacttagaaaaatctttcttttgttggaaacacactcaatgatcatgagtatctacacattacctctctgaagattttgtacatctgaagatatggatatgggactcatcaaaaggatgatctttgtcagcttatcatccttctaggcacaaataataaaatttaaacaggaaagaaaattgtctcccataacaagactttcgaaagtggggaggtatgagcagttaaatcaggggcaccatggaggttcttttttccatttactatgacatccacaagaatccagttcttgagatggttgtagctctggtcaccgcttgctcacacagaagtagggaagtctccttccatgtgacttttttaaagaaaaaaagaaacctaattaggaaatttttaagcaaacttccctcattttgcattgccagaattgggttatgtgtccgtaaccaaggcaattggtgccaagaagactggaattatcatgtttcttttatgctaataaaaattcacccaccttttggtttggaaaaaggccatccattcatgaaagaagctaaaatctatttttttaaaagaaaagtgcttaaggtaaaaggaagaatggcagtgaggcagacaatatatctcccagaaaggcatttaaatattgaccatagacaatatttcttcagagagtatgtgataacaactaaaaagggtccaagaacaagtcctgagaatattgaatatgttgatattgggagaagagaaagatccagcaatagaaaaggaaaagccacctccccgggggcagtcgtgttatggaaatagcagaagaatttgtttaaatagttaactgtgatgatatcttttagataataaggaatcaaatagaatgattgttgaccttctaaaaattatatttagtgagagaaagtccctagggattttaggataacaagtcagtggaatggtgggcacaaacccaaaatggagtgataagatttgtgaatataaagggaaaaaaaagaaaccaaaaggtgttcaatacacagagaaaacctgctgggaatttgtggtaggcagaatatgggccccttaaagatgaccatgtctcaattgttacaatctgtaaatatgttaccttacatggtaaaagggtgtttgcagttaataatttagtatcttgagatagaaagataatcctagattatttcagtgggctcaatataattgtaagagttctttaaaaaaaatttgttttgatgagtttgggtatatacatacacccaggaaaccatcatcacaatcaaggtaataaaatatgcatcacttccaaaagtttattcctctttttccttctttccttccttcctctttcttttccttccttccttcctttccccttcccttccccttcctttccttccctttcccttcctttccctttatcctttttttcctttccccttcccttcccttcccttcccttccttccccttccccttcccttctctttccctttccctttgacttccttttccctttttccttccctctgctttcccttcctcttctctcttttcccttcctttcctttctctttctctctctacctcctttccttccttcctttcttttaataggaacaacataagaaaagtcacgacggttctcaaaagagtgaggcaggagtgaaaatcagagagttttgccaatggcacactgctaacttgaagatgaagggatgggcacctagccgagcaatgcttggcagcttctagaagctgaaaaggcaaggaagcagattctcccctaaagcttctagaaggaatcagccttgtagaaacttaatttcagctcagtgaagctgatttcagactcctgacttcagaggtgcagcaaaaagaaaatctgttgttgtaaaccatgaagtgtgtcataacttgttacagtagcaataggagactaatccaaaatgctttaattgtaaagagagatttttctgatgaagacctgatttcaaagaatatggtctatttctccaaaggcacctgccaaaactcttcaagcaacaacaacaacagagtagaccattatgccaatatggaataacatctgatatatttgtatggatcatttaaatatttataaaataaaatatgtacattatgaatttaaatagatgcatacttatgacagaaaatatatttataaacatatattttacttttataaatataccctgacatgaaaatgagtcaagtacaaaattcgtatatacataaaagactctgagacatacccactttgaatgtttaattgtgtctcaaaattagtatgttaaattgaaattgcaatccttccccttacatagtctgacctatcttctctatcttaaatatcactgatattgtcccccagtaagcttgaccaaaaccctcgaaaattatctttgatttcctcttattctttcccacttcacagtcaaatgtcaccaaatcctaccagacaggtttctaaatatatgccagatatgaccgctccttctacctccaaactaccaccatagtataagttaagataatttactacctgcactattattattctctcaccattattgtttctctccttggcctatacattttagttatacagtagttggaatatagactgctgtttttaaatttaaatattactattctggttaaagccctctgatgccttatgttagaataaaagataaatttaccaccatggctttcactcaaaattgtaatgtttgaataatgaatctttttatctctcccactagaattgagctctctgagggaagaaatattgtatcttgaattttttttcattattttctcaatagcacttagtataagacaagtagagatttcaataaataatagtaattaataaatatttgttgaatgttgaatatactgttaagaggtgaaatgaaagtgcagaaaatgtgtataacttgggttcaataaactgcttatctgtatatgcacacacacatatatagatttcgagttattaaaataaatacatgcttaaaatttatttactgatacctttgctaaaattttaatcctgtgaaagtagggatatatttctgttttgtgtgatatatctcaaattctaaaaataaatctagaacctagtgaatgctcaataataattttggcaaatgaataaatgaatgaatgaatatatgtgtacacacccacattttttgtacatagacattgtatgagttacatcttgctgctgtaactaattaccaaaaccttagtggcttaaaacaacacaaatttacgttgttatcatggaggagatcaaaagtcaataattggttccactgggataaaatcaaggagttggtcaggctccatcatttctggaagctccagggaagaacaattgccttttccagcttctagatgccacttacattccttggctggtggccattgcctttgccatcaaagcagcatcataacatcttacagttctcttgttttttttttttcccgagatggagtctcactctgtcaccaggctggagtgcagtggtgcgatctcggctcaccgccacctcttcctcccgagttcaagcaattctcctgcctcagcctcccgagtatctgagactacaggcgcaggccaccaggcccagctaatttttgtatttttggtagagatagggtgtcaccatattgtcgggatggtctggatctcttgacctcgcaaaacgcccacctgggcctcccaaagtgcggggattataggcatgagccaccgcgcccggcccttacagttctcttgactttgaccactgcgcctcccttttctccatgtaatgtaattgtctcttcaaataaaatacgcccacctggaaagtccaagataatctctttattttaaagtcaactgattagcaatctgaatttcatctctaatcttaattgcccttttccaggtaacataatgtattcacaggttctggacactagcgcatgcacattttgggaagaatgttaacctgtgcaccgtacacattttctaaaaacgtaaactgaaagttacctacagagtttgactatggaaaaagtggtgaatatccacactggaagggaatttaattaatggtacagaccactgacttcaaaacatggtgcctagagcagcagtagcattatcagcggagaacttaggaaaagtgcaaattcttaggccctacccatacctactgaattaaaaactcttgagtttgggctcagcaatctgttttttaaaagctctccagatgatatggattcttgctaaagtttaagaatcactggatcatactactccatacttggtttttatactaatgttgtatctacttacatttaaatgaataaagtgttttagtaggatggcattcattcaacttagacaaaatatgctttttaaagaagtattacactttcgtagagccaagtaacattaatagtataaacaggtataaaagaataggcatgcccaatattagtaattacaaaagttatttcaaatagatataaattaaggtaatttaaaatcactgatctttagccttggtaaaatttgattatttatttatagttgcaattgaaaatatattaaagttcatttctttaggcctaaattaattacacaatcttaatttctgtatttgaaaatctatgaaaaaattttaagcatattttaaaaaataatataagaaacattgaaatattaattattcttaccaaatgtagccttcttattttatatatttatcttaattctcataaatttactaaagaacataactacaaggttttaatgccttaaataccttaaaactgaacataaaatccataaatccattgcctctttagctatgactctggatcacagccagattaaccatggtaaggcagaaagaaatgctgcgggttcaggaaaaagaggaaatagttcaatgattagctgtcgtctcttccaccatctaccaaatatctgcttcagtaatcttatcacctattcaattcagtgacttctcccaagaggacataactttaggtccaatacaaaaatgtcatccaatcctagattgagaatccatcaccaatgcccacttctctccactatgcctgtttatgtctctgtagcatctgaagacctaaggagaaaaatgtatctaccccactgtccgttctcacacggctatgaagaaatactgaagactgtttaatttataaagaaaagaggtttgattgagtcacagttctgcatggctggaaaggcctcacgaaacttacaatcatggcagaaggcaaaggggaagaagggcactttcttcacagagtggcaggaagaagtgttgagcaaagggggaaaagccccttataaagccatcagatctcatgagaacagcatgggggtaaccggccccatgattcaattacctcccactgggtccctcccatgacacatgaggattatgggaactacaattcaagatgagatttgggtggggacacagccaaaccatgtcacccacctccacagctgaacacaaacacagacacacacattctctgtctctctctttctcacttttccattatgaacagaaaccaaatagaagaagaagaggaaggcaaaggaagaggaggaggaagagaaaaggaggaaagggaaaggagaaagaggaggaggtggggagcaggaggagaattggaatcacacagtgctcatcataaatagcaatgatgaaatcctgctgagttaggattgagagatccttccaccaagcaggcatggagagttgtagggaggggattgaggggatatgcttcatgattagatcctaatgctcatttctgggaagaaaactcttgttcattgatttccaggaatcctgattcagcaacctatagtatattcttatctgatattcctcatggctatgcctgaaggaagctgcacagcttacactcttttcctccttctgcaaaagtgaggacacaaaaaatctcttgaacagcaaaagtcttttggaagtgatgttttctagacaatagaattgcctcaactaaacagcactaatgtctcacttatataattctttcttgcaataatcatacccaaaatctctcccctgaccctgacttatatataatgcctcagtctgcttgattttattcttccatgacctaggcttatctctcaacttaatggtgtaaaacttagcgtcatatgaaataataagcttatgtgtaatcccatctttgttgcagggctgaatactgtgatagatttaataaagaaaaaaaatggtggggagcagtgactcacacctgtaatcctagcactttggaaggccgaggcaggcagatcacctgaggtcaggagttcgagaccagcctggccaacatggagaaaccctgtttccactaaacatacaaaaattagccaggcgcctgtaatcccagctactcaggaagctgaggtcagagaatcacttgattccggaaggcggaagttgcagtgagccgagatcacaccacttcactccagcctgggcgaaacagcaaaactctgtctcaaaaataaataaataaataaataaataacaagatcacaattctttacctaaatcttatccacacacttggcaatataacttagaatttcctcccattaagagatgtgcattccctgggatctgaactgaccttgtgaattgctttggctggtggaatgcagtggaagagtaaacatatcacttctgagcttaagccttcagaggctttgtctgtctctctctcttctgtttttctccttctctatctctatccatctctccctttctctctccttcaaaaccctgttgccatcatgtgtgaacaagcttgggttaatctgctagatattttaaaatacaagttccagacttgacttttgtcccaactgttggcaggtcaaccaccaaaatacggggccattctagactagccaagccctggccaatgtgtcagtcaacttcaaattcataagataacgctgctgagataacctacaccttacccagatcaacaggctcacatagttgacctacagatttatcagccataaaaagggtatattgttttaagtcactacattttgcagtggctggttatgtaatcaataagtaattgatacagttctttagtaatgggtgtataccttcaggtttcataccagatttatttcttgtgctttggactcaaattttggactttggaatctgcttcaccagagtggaccagaaaaataaaaaaccactccagctctagaatttttgagcaggaggggttttccatattaatgaaaaggtacttacaaaagcatgaattttctgaaagaagtaagtcagaaaaggatgtttcagttttaccagtggccttctctaggaaccagagaaaacaacttgtattaacgaccatattctgaatatatgaatgtatacatgtacatactacatatatttttttacaagcaataacatgtcaagcaaatgcatgtcataataatgctaaggcaataatattactagaaaatatatctactaggaaattcaggcaaagaaacaaatgtaatatctttagtaagacaaacatttttgtttcaatatgaataaaataaaaaaatcacaaatttgtaaatatttgattacaataagtctacttgcagtcgtaaaggacttaaaggacacagatactaaattcatgtatctagtgtcaaatttgtgtaagttacatcctctgagtactatcttgccttgtgttttgttaaaaagtggaaataaaagcaactaactttcaatagtgacacagtaaaatagtaatgtctatcatttttattgaattgacaggtgttttattgcaatgactaaatcagttggctatttcagcatcagttataaacagactgaaacgacgtttacattcaatcagaggaaacttttcagtgcaattctgtgagtaaaagttattacaattttattaaagatgacattatgataagagtttaggcaatttagccaaggtcaagatatgagacaaaaaaatacatagacagataaacaactttggtattcgcagactattattattaaaatagtgctataattttcacaaatgcgatcagatgatatatcattttagcttgtatcttaatatagaaattatggaaatatttacaatctctctcttcctctccttaatgtcactcttcatggatgtagctacatccttcttatttatattccttaaagtacaccaacatgactattatcacagttatttgttacaaaatgacatttttcccattgtggtctttttaatgtgctctcatctcaaatttccttcaaaattgaaattttgtagttaaatttcagtaacaaaataaaagtaaacgatgaactaaaagtaatcaaaaagattcacaaaataataataggtacatgcaacatattataatttataaataagttgtacagaaacctatctttattttaaactgcatgaaacattcatctctgattactaaacactatcacggatatttcttatttagcatatttgatattgaacagattataataggattgtttcagttttgctcatgtcaggtattaaacctgaacctgatctcctgattcagctggggcatccataaataatactgatgaaggcgtcacattgctagaggaaaccacatacatgcaaatacttgttgatgaaatatgaggttagaaaaaacctcattggtttaattagccaagaacacaaatgcacatgtgaataaaagtagaaacaagggccataaccagtgcagtgcataaggccctcccttgaacctcagtatccctaatatgaacatgtgtctgcaaaaaggagggtcttgttggatacctaatcttctttttgaccataagcagtattttctgtctctctctcaatctcttcacttatatatgtttatatgtattattatatataattatatataaatagatgtagttatataattatataatatataacagtcacatatagtttaaatatataaatatatattattaaattttaagtataaatatgtattctatatgattataattatgtataagtacagatttatatatttatactatatatcaattcataaataatttatatgtgtaaattttatatatacattttatttatataaatatatatataaatatgtacataaatactataaatataatgtataaatttttatataagtaaaaaatatatatattttttgagatggagtctctctccatcgcccaggctggagtgcagtggcacgatctcagctcactgcaacctctgcctcccgggttcaagcgattctcctgcctcagcctcccaaaaaaatatataatttttttttagagctagtgtctcaatacgttggccaggctggagtacattgtttattcacaaggtgtgaccatagctcactatagtcttaaacacctggcttccagcaatccttccacctcacacttctgagtagctaggactacaggcatgcaccactgcccacagtgtttaattttattttatacacttttttgtgacagggttctactctgtcacctaggctgcagtgcacctaggtgacatcatggctcactgcagtctcaacctccctgggcacaggagattctcccacctcagtctcttgagtagctaagtctacaggtgtgcacctccacacctggctaaccttttttattctttgtagagatggggttttgccatgttgcctaggttgatattgaactcctgggcttaagctctccacccacctggcactcccaaattgctaggattacaggaataagccacgacacctggtcttaaaaatttttataatacttttattgaaacataatccaaaaccatgaaattcaccaccctagctctattctctcccccaactactaatcctagacaaccactatttttctatttctatataatatatgtctattttggacatttcatatactgcatataaaatcatataatatgtagacttttatgaatgacttcttttacttagcataatgttttcaaggttcatccatgttctagtatgtatcattacgttatttcattttattgactaataatattccattgtatgtatacacaaattttatttattcactcatccagacagatatttgaggaattcctaattttggggtattttgaataaaacttctatgaacattagtgtacaagtttttgtgtcgatgtatgcttttctttctcttgggtgtatacctgggagtggagttggtagatcatagggtaactgtcttaatccatttgtgtttctataaaggaatacctgaggctgggtaatttatgaaaaaaaaaaagttttatttggttcatgattctgcaggctggaagactgggcatctagtgaatgcctcaggctgcttctacacattgcagaaggtgaaggcggggaggccagtgtgcagagatcacataacaagagaagaagcaagagagagactagggaggtgccaggttctttttaacaaccggcttttgcaggaagtaataaagtgagaactcactcactaccaagccattccagagggatccaccaccatgacccaaacacctccaattaggccccatccgcaatactgaagatcaactttcaacctgaggtttgaaagggaccaataaatcatagctaaactatagcactaactctttgtttaactctttaactgcccagctattttccaaagtagctgcatcattttatatttctaacagcaatgtatgaaggttaaaagctttctacaccctcaacaatactggttattgtttgtcttttggatcatagccatcctagtaggtgtggagtggtacctcaccacaaaattgttttgaatctccctaaatgtcagcaaatgttgagcactattttgtgtgcctgttgaccacttttgcatcttctttggataaatgtctatccagattatttttccattttttattaggttgtatttttgctattgtgttatgagtttttttgtatcttcaagatacaaatcatgtattagatacataatttgcagatgttttttcccattctataaattgtcttttaacttcgttgatagtatcctttgaagttcaaaaaaatataatttttgttatgtgtctcttttacttttgatgtcaaactataacagctttaccaaacctaaggtcacaaatgttactcctatattttcctctaagggttttatagttttagatcttacatttaggtcagtgatccattctgaggcaacttttgtatatggtgtgaggtatgggtccaagtttatttattacatagattatcttggtacttttttttttttttttgtagacagactcactctgttgccagggctggagtacaggagtgcaattatagctcactgcagccctgatctcccaggctgaagtgatcttctcacttcaacctctctagtagctggtattacaggcatgtgccaccatgacaggttaatttttttttttttttttttttttttttttttttagtagagacaaggttttttttgtggttattgcctaggctgatctcctgagctcaagctatccttcctcctggccctcccaaaatgccaggattacaggcgttagccattgtgtccagccttagtacctgtttaaaataatcaactaatcataaacatgagagtgtattacttgacactcaattctatcccatggatctatatgtctatccttatgcaagtgccatactgtattaattactgcagtgttatagaaaattttgaaattaagaagcgttaagtcctccaaatttgttatttttcaagattgctttgactattctgagtttcttgttttctcatatcaattttagagtcatcttctcaatttctgaaaagaatcctactgggattaggtttatgattgcattgaatctgtagatcagtttgggaaatagcgccatcttaacaaaataaagtctttcaaaccatgagtagataatacatttttattcttttagattgactgcaatttatttcaaaatgttttgtaaattttagactataaatttggtatttcccttgttaaatttattcctatgattttttttcttttgatgcaattgcaggtaaatggcattgctattataactttattttgatattgttcattgctaatgtctagaaatgtcatggttttttaatattgatccgtgttctgcatacttggtgaactcatttattgatattaatcagttatttttgtttttaagttaatagattttatttttagagctgttttctatttatagaaaaattgagcagaaagcacacagagttctcaccctctttctcactcactctgttccccaccaattgctaatatcttgcattggtgtgatacatttgttacaattgatgaaccaatattgacatattattgttaactaaatttcatggtttacattagggttcactctttatattgtatagttctagggattttgccaaatgcataatggcttgtatccaacattagaatatcatacagaagagtattactgtcctaaaaatttcctgggcacaaccaccttcccatccactcttgtcaaccactgatctgtttaatgtctctatagttttgacttttctagaatgtcatattgttagaagcaaacattatgtagcctcttcatactggcttgttttgcttagcaatctgtatttaaagctcttccatgtcttttcctggcttgaaaactcattattttttaacaccgaatagatgtagcacagtttattcattgactcttgctgaagaacctttccaagttttggaaattatgaataaagcttctatacatattcatgtgttactctttgtgtggatgtgagtttttaactcatttggataaatacctaaaagcacatttcctgaatcatatgttaagactatatttagctttaaaagaaactgccaactgtcttctaaaatggctgtatcattttgcattctcaccaggaatgaatgagagtccccattgcttcacatccttgccagaatttggcattgttagcattttgaattttatctactctaataggtagaaaagtatctcattcctgttttaatttgtaattccctgtgacatatggtactgaatatctttttatatgcttacttgcatctgtgtgtcttctctgatgggttgtctgttcagatatttttcccactttgtaattggggtgtttgttttcttgttgttaagttttgaaagtgtttcctttgtataatatattggacacgatcctttaacacatctaggtttgaaaagatttttcctaatctgtgtcttgccttttcactctcttagctatgtctttgacagagcagaagacttaaattttcatgaagaccaacttatcaatgttttttgtgatggattttgctattgtttttatatatgaaatatttttttgccacattcaaggtcaccgaccttttctcctgttatgttctagaagttttatagttttgtatgttacatttaggtttatgattccttttgatttcatttttgtgaaatatctagggtctgtatctagaatctttttttttttttttttgaggcggagtctctctctgttgcctaggctggagtgcagtggcgtgatctcggctcactgcaagctctgcctcccaggttcacaccattctcctgcctcagcctctggagtagttgggactacagggacccgccaccaagcccggctaattttttgtatttttagtaaagccagggtttcaccatgttagccgggatggtctcgatctcctgacctcgtgatctttcttcctcgacctcctaaagtgctgggagtacaggcgtgagccaccatgccctgctgaattatttatttatttatttattttgcacatggatgtacagttgtttcagcatcattgttaaaaagactatcctttctgcattgaatttcctttactcttttgtcaaagatcaattgactgtatttatctgggtctatttctgtgctctttattctgttcctctgacctacttatctgttctttcacctataccacactgtcttgattattgtagctttcttgtaagacttgaagttgggtaatgtcagtcctccaacttcatcttcttcaatgttgttttggctttccttcgtgtttcctttccatataaactttagactcagtttgttgataaccaaaattaatttactgagatttcaataaggattaaatggagtctactgattgagaaaaactgacgtcttaataatattgagccttcctatgcattaatgccattttgtttatttagacctttcttgaattccctcatttgagttgtataggtttttctaatatatatatagtgcatattttattatatttagaacgaattgtttcactttttgctgctacattaaatggtggtgtgatttttattattttcaaatttcagttatttattcatggtatatacgacagtattttacttttatatattaaccttatatccagcaactttaatctcttattcattctagaagggttttgttgttgttgttgctgttgttgttgttgattctttggaattttccacatagacaattagtcatgtcatctgtgaacaaaaacaattttacttcatttttcctcagtctatataccttgcatattcttctcttattgcgttagccaggattttattataatgtgtaataaaagtggtaagagaaggcattcttggattgttctttatcttagggagaaagcacctagtttctcaccattaagtataaaatcaggtatagattattttggttgctgtttatcaagttaataaagttgttctctatttctgggttgctgagattttttgcagggggtgttttcttttcttttctcatgaatatatgttggattttgtcagatgctttcgaaaaatctattaataggatcttgtgaaattttcttctttagccttttgacaaggtagacatttatgaattttctaatgttgaaacagcctggaataaattccagctgctcattgtgtataattatttttcatacacttttgaatttgctttactgatattttattgagcaattttgcatctgggtttatgagagatgtaagtctttagattttctttttggtgatgtatttggttttggcattagggtaatacagctgactcttgaacaacacaagagttgagggtgctgatccttaaacagtcaaaaatttttgaataacttttgactcaccaaaacttaactacgaatagcccactgttactgataacataaacagtcaattaaaacatattttatattctatgttatatgtgttatatactgtgtttttacaataaagtaatctaagaaaaagaaaagattgttcagaaaatccaaaggaagagaaaatttgtgacttttcattaagtggaagtggatcatcacagaggtctttatcctcatcattgtcatgttgagtaggttgaaaaggagaaaaaagagttattggtcttactgtctcagggctagcagaggtgggagaagtggaggaggtgggagaggaggcaggagaggctggcacacttggtgtaactttatggaaatacatcctaatttctgttcgacagttttgctttttatttttctaaaaatatttttggctggatgcagtggttcactcctgtaatcccagcagtttaggaggtggaggcgggtggatcatttgaggtcaggagttctaaaccagcctgggcaacatggtgaaaccctatctctactaaaaatacaaaacttagccaggcatggtggcgggcacctgttatcccagccacttggaagactgaggcaggacaatcacttgaggtggggaggtggaggttgcagtgagctgagatcacgccactgcactccagcctaggtgacagagcaagactcggaaaaaaaaaaaaaggcacaaaacattctacatggtgcccattcttttccccccgtttgctttagtttcagcatcagggtctaagctgtaaaagaagttaaaagctgtcttgaataatcagaacacttctgccagattgtctcacgttagtttgttttctggccctgcttcttctacgtcatcttcctcattgtctagcattggtttggaagtgctcatctccatcaagtcatctgttaattcctcttgtgtggtgtcaataagctcttgaatttctccatgatccatatcttgaaacccttcatacccacccaaccttttttttttttgccaaatacagacttattttcatgatttcctttattggttctgtcctaaatcctgtgaatttttccatagtgttgacaatttttttctataaactattttttataaagtccttatgacccctgatctagaggctgaagtagagactttgtgtttgaggcaaatagaccacttagatgcctttgctgttgaactcatggtgttctgggtggccagaggcattgtccaatatcaaaagaactttaaaagacagtcccttactaacaaaatgcttcctgacttccgggacaaagcataaatagaaacaatccagaaaaaggattctcattgtccaggccttcctcttgtacaaccaaaagactggcagctggggtttatgttttcccttcaagcctggggttagcagctttgtaggtaagggccatcctgatcataaacctgactgcatttgcacaaaacagtagagttagcttatcccttcctgcctcaaatcctggtgttcacttctcttctttattaatacatgtcctttgtggcattctttccagaatagagcacttttgtctgtgtgttcaaaacctgttcagtcagatatattttcttctcagtgattttcttaatggcatctggaatgtgtctgctgcctcttagttttcagaaactgcttctcccgttatcttgacattttttaagccaaagcctttttctaaaattatgaaaccatccttgctggcattaaattctccagcttaagattcgtcgtcttcttttttctttgtcatataatgactttgctttttctcgaatcatgttagagtctatagatatgcctttcttacagcaatcctgcacccacataaaggctgcattttcaatatgctataaaaagggattccattaaaagtgcaaggtttttgtgtttgctggaatagctacaacaatggcttcacaaattttctttttcattttttatgatggtccttacacgggattcctttattttgaaagggtggccatctcagctgcagacttcaatctacggtacgtaccaaacaattcaatgtttttcttgtagtgtcaggacttttctcttcttcttgggagcacttccagtatcactagtgacactttgtatgggtctcatggtattattcaaggtttatggtattacactaagccagatgaaaaatacatgcaagaaccataagaggtcactttttatgcaattcaaaatttactggagagaggaactgctcacatggcagttaattagcttcacatggcatatcaggcctctactggcaacacttgagctcaacacaagagcaacaagaggtggctacaaaattattacagtagtacagcatgcgtaactgttaactgtatgcagttatgatttattgcagtatctttatgtttgtttacatttctcaggactgaaaatggcaccatgtacaagtctgtgtttgtgtgtgcatcttgataaattttaactttttataatagacatgtgtaatttttatggtagtaaatgataaaatagactagtatctacatacattctatacacttatgacatactcaacaattccttaatcttttggtgtttctaggctacttggttcatctgagttttttaaagtgtcccaaatctccaaaacatttttcaatgtatttaatgaaaaaaatctgcatatgaatgcaattcaaattcatgtttttcgtcaattgtactttcctcatacaatgagttagaaagcacttcctgtatttctcttttctgaaacagatttcagaaaatttgtagcattttttcctgaaattttggtagaattcaccagtgaacccatctgagcttggtgctttccatttgttgaagttcaatttctttagtagatacaggtctattctaattatctatttgtctttgtgtcagtctgagtagattgtgtccttcaaagacttggtccgttttatccaaattattaaatttgtggccatagagttgctcatattatctttattgttaatataatgtctattattatgtgtttattaatattaacattaatataaatattgtttttaatattatgtctttattatcccattaatatctatgaaatcagcaataatggccctttttatttctgatattgattatgcactgtatggcaatgtttcagtcaatgatggactatatatgtgacagtggtctcatactgtatttttactgtagcttttctatgcttaatgtatttagataaacaaatacttatcattgtgttacagttgtcacagtattcagtagagtaacatgttgtacaggcttgtatcagagaagcaatgagctttaccacatagcctagatatgtagtaggctgtgctatccaggcttgtgtaagtgtgtgcactctatgatattcacacaataataaaagtgcctaatgatgtatttctcagaatgtattcccattgttaagtgatgcatgtctgtattagtaacttgtgtcttcttctttttctcttggctagcctgctgagggtttatccattttattgatctttttgagaaactagcttttgatttcgttgattttctctgttgtttttctgttttcagttttattgatttctgctctgaattttattatttatttccttttgtttgctttggatctaatttcctcttctttttctagttgcttaatatgaaagctttgattattgattttagatgttccttcttttcgagtgcattcaatgccacaaatttccctctaatcactgtttgtgctgcatcctacaagtgcagataggttgtattttcattttaatttagttttaaacttttttaaaaatttccctagactcttgttatttgaccaatctgccctttagtgtgtgttgtgtaatctccaaatattttgggatttttccagctatattcctttaattgtttcactttaattccattgtggttatagtatactttgatgtctctactgttacatttgttaaggtgtgttttatttcacagaacgtggtctattttggtgaaggtaccatgaggtttaaggagaatgtgtactctaccattgtttatgattacaaaagagaatataaatatgtatttagtcttttctttcattaattgatttcttaaaattgtataaaataatgtatatttggcaattgcagggcaaataaatgcaaaggaataaatgaaaacaacaagaaacggtaaaagaaaggttaatgtagcaaaacctgtaaatgtacagtgctctcctttcttctctcagcttctttagtagatataaaactatataaataaaaattataacaatttattgttgtgagtgtagaagtgatatgtgtaacaataatagcataaaatgtgaaaagatgtaatagagcagcacaagggagacgttgctacctcactgaaatttagtttctataaatcagtctttaattgcgtgctgactgccggattgtttcccataacgccttgtggcttacatttctccagtctgacttgatcaaatttgggcccttttgcaggaatagtttcactggccagcctatgtagtgtattctgatgcaaggaaggctctccttagctgccttttctcctggttcactattgtgaaccagattgttttacaatttagcttgtcaccttctaggagctaccagcctcctcttaattgtttatcaccaaaatgttcattgttttctagagcacccttgggcttaagcttccccattctcttttatgaagtctgttattctgcggagagattcacagtttatgtcttatgatctactacttcctttgggaaaaatctctaagccacttaggagttggccaatgggctgtttctctcagaggaagtatcctgttttatgaaaggggtgctgggtgggggccgtagcctctggtggtggctagtgtggaaccactgccctacaagctgggacaagggcagaagagacccccggattctcagcctgccatgcctaaggtggagcattcacctttgggtggatcaggactgggtggaaaaggaagtctcataactctaggccacccttgcgtggattttagcctctgataaacagagcgtggtgggggatgggaaatgctgaagatctacccgtacagggactctacggtagccattgactgtgaactacggggcagggggaagagtttcctcttcctgaccatgtgtgctagatcagagcgtccatcagtctgagctagggaatagagggaaggagcaagctgtggcttcagtgacacagagtctcactgttattactgagatgtattagatttttttaaatgaatgtttcatcacttgctgtgtgcccttaggacaatttccagagactttaaatggtggttgtttttataatttccactgtttgtagtgatttcactagggatctattctgcagatgtcctcatgctgccattcagcatgttaaatatttttatattataattttatataattcatttcaaataaattaacaggtaatgttctattgtgtccttaagcatagtgacttcttcccttgtgggtagatggcatgggaaaggcagagttagtgtttaggtgccttgaacagcacaaatgccttctgggttccagattcaatgagattttactccctgacaaatagtgttagctttcagttgtacacctcctttaacatatctgctgattgagaagttgggtaaaattgtacttcctcaatgcctgctctgtgtgggccattacatgtcccaactattttgatatcctttggtaagtaaataggagaactaatctatatatatggtgagatttatcctggtaagggtgttagacagtttagccatatctcatgtaaatcatagaacacagcttctcaagtatttcactaaatccctaaataattcatttccaaatcctttggtattattattttaattttttatcttgactactcactattcatcttggagcattattaaacaaaatatcgcttacaataataatagctaaactctttcgctccactcttaagttacaaaactgcaatagaattacagggaaagttcatggtttttagaaaaacgaagtccccagtacccccgcggctcccgtaatttttcccgagacaagttatgactgcaaagcgctatttctcccaaaatgatctcaattatatggctcattaagaggtgggcattttgtcaatacaaagatactgtgcttaagctacccaatgcttaatagtgcttcttaacagatattcattacacatttaccaaatgaattaccaaatgaatgaataatcattaactaaaactgcttcagtacaaggaagtagaaaagtatggtatatgcatcttaaaaacttggaggtggttttcttgatataataaagagcaaactgaaataaacaaagaacagacttcaatgatgctttccttttgtgaagcaagagtctgactgagtagtaaatgaaggaaacctagaaagactccactcatattccaagctgactgaagaaaaacgtaatagaagtagatggaagtgtcatccaaaagacccccaggatgactaaatagcagaaaatagggttttttaggtgataacagtttgcaaaccaggaagagaacgtctccattgagtactaaaggtgttatctcttcaaagaggaaagaggcaggttggtttttgcctcacagggcttctattacacaataaggtcatacatattcagcatgtttgagggaaaagctatacatatttatgaggggagctgagcacatgtgcaataggtaaacatatatgtaacatacattccatgttcactttaacgtggggttttgacactaaaatgaggtagaatttggctctttatgttcaaagaactataggacacaaggacagtttgtgcaaagtctctataagctggctaaacctggcttaatgtctgcagttgcttatcaggaaagaatgcttgtaaagccagcggctgttcaatcatagctatattgttctgggttcaaaaccagagtttggaaggggctgacaattttcctaatagctcctatcgttagggagcttagtaaaagtgtgttttttcttgtagctataggaatttaggaagttgccatgccagccagggcatgaacccttgacctgtaggcaacttctgtttttgcaattttagatttcatagtagttgataaaggggcaactattttggtctctcagatcaaagagacaatatataagtttcaccagtgcctccagagatccactgcaccacagtgtaagtgcaatgaataatggtgcaatgcatcctctgctgttccttaacaactgggcccctcaggcacaacacgccattgccttaactggccctccatcacagctaccatgcagtcaaggttcgtaggcaccgctacctgcaaaaagctctgctatggcatcgaaatgtctttctacaactgtctccaaatccagacttgactattctccaattgattcatctttaggttgcagaatgtctgtattagcaaagtaaaaaaaggataaaccattatagtttcctactctatggtaaacacaagaaaaaaaatcctaaataaatgtaaagacattaaagtaaaaattaaggtaaccactaagaaattgttgcctattacaagctaaattttgtgttaccctttcctcattcgtatattgaagccctaacccccaatacctccaatgaagatgtggtctttaaagaggtgattaagttaaatcaggttcttagggtggactctaatgcaatataactggcatccttataagaaaaggtgattaggacacagacccacacacagagggatgtccacgtaaagacacaagaagatggccatatgcaagccaaggagagaagtctcagaggaaaccaaaactgctgataccttggtttctcagccgtagcctctggagttgtaagaaaatacatttccattgttttagtcacccagtctgtggtattttgttatggcagccctagaaaactaatatactgccaatgtttgtctttgaaatagaagtacaagtctacaatccttgttttcaaaactcttgggatctagtgtaatttgcagttatttatttattttttgtattttggaatgtgtcttatttattatgtaaaactccatcagtggactggggtaataccatgtaatcaaactcatgaagattctgcagggaaatgtatgactacacacactaaggggaaaatatacaatacaaatagcttcacataagctcgggtcaagatttggtaccaaataactggtcacaaaccaaggcagataaccatggattgcccttccacattttctttacctcattcctgaaataaatattagaattgggtaggaccccttgataaggagaggttgtctattgagtaaattattttataaggtgaatgtttaatggcattttggtttattttttagactgcttctaaatgtcaaaataccagtcagtacatccttgatataggttactttgctgatatgaagcaatctcagtgatatgcccctcctccaaacctgtgtatctagaaatactaatacaccttgacaaggtgtactcaccgaaacttcaagtgaagtcaggtttttaaacatttctcatttactggtagattcaaccctttttttttttttttttttggagacagagtctctctcttttgcccaggctggagtacaatggcatgatctcagctcactgcagcctctgcctcctggcttcgagcaattcttgtgcctcagcctccagagtagctggcgttacaggcacccaccaccacgctgggctaatttttatatttttagtagagatggggtttcgccatgttggccgggctggtcttgaactcctgacctcaggtgatccacccacttcggcctcccaaagtgttgagattacaggagtgagccaccgcacgcagcctagactcaactgtttgtgtctagttatctttggttaattgtggactataagttttattgtgatttgattttttttaatgtttgctacccttatattctgaacataagaccagagatcaagatttcatgataaggcagtaggcataggatatttagtaccgactgccagcatgtcttgcccagtgaaaatactttcttgtattgaccacacatagtcattcactgaaaggaaaaggagtatgcaggttctcatgaagcaacaagaattctcacccagctcaagttccttccaattaccttgttgatattgtaaattgagagtgtaattctgaccatcaggttgctgtcagggattgtttctggtaggagttcctgtgcaccattgaaaaccctgtggatacaaactcatggagataggtcagagtgcagaagtatcagtgatcagccctccaggggcgaccaatctacattctttgattgttttcactccccacaataagaattccagccttgggaggaaaaatatatatacaatgatctgtctcttgggaggggtctgtgtttctaagacaacagtgttttaaattaaatgcagattatcatacggggtttaacagtcgccctcctctcaaacctcacatccacaggaatctcaatatgtgatctcatttggaaattgtgtctttgcatctctagttaattaaggttattttagattagaatggatgactgctatccttataaaagggcgatgtcaagacccacacacaatgaggaggacagcatgtgatgacacagacagaaattaatctgattgagctacatgccaaggaaatccaaggatcgctggcaaccaccagaagcaagaagtgagacaaagaacaggttctccctgagtcctcagaaggaagccactctgccaacacctttgatttcagacttccagcagcccgacctgtgaaagaagactttgctgttgttctaagccatccagtttgtggaattttgttagggcagctctagagagccataaataatttcatcctactctatggtaagcacagggaaaaaaatgctgaatgaatttaaagacattaaagtaaaaattaaggtaaccactaaggaattattgtctattaggggctaaattttgtgttaccgttttcttattcatatgttgaagtcctaacccccagtaccttcaatgtatttgaaagtgtggtcttcaaagaggtgattaagttaaatggggttcttagggtgaactctaaagcagtataactggtgttggaagaagtattccaatcaattttcaactaaaatatagtgaaagagtctttgagtctttatagtttccaacaacgttagtttattaataactttaggacaataagaaaaatctagtcaatgaattgtctgccttcagcttttgggaggaaaaataaataaataaaaaagttcctggctgttattttccctgtactcttcactgagcaaagtcttgccctcatcttagtctatttcactctcttggttctcccctggcccactaaatcctgttctgcctaccttggagtttttttatttgtctatccaaagatgcatagttaaaacaaattccaaaggtttaaaatattttaaaagtcaggtattatgttgtctacatgtagatgaaagaaggaggtggagtacgtttaatttagtataactgtcccacgtgttacttgatcgataagggaatttttaccaaaataagattttttttacaataaatataatataaatggcactttttgcattgaacttgacaaaaaagttctactttcttttcaaaatatttagagtttattttatgagaaatttttaatatagcttcaaaaatgcattgagggcaagaaggcactagccaacccaagggcctattttctgtgaataaattttcaacacaaattatgtgtgaacctcaacactaactttatccttcagtacaagtaatacaaacacagttttccatatgaagatgcatttattactaacttgtgattcagtgtcatttccatggatatgtgctttcaataattctagagagaattcagagaaatttaaaaaaatatttagcagtttttcactttaattttcaattgattatgaatttgcctctgccttacagctgatgattatttaaaataatattcaagagtcatatgtactggatttaagaattgtttcccatattcaggttgttgcacacacaagccagctttcatttacaaatgccttctgacaaagcacgcaagatattaaaacgaaatattgtcaagaagatggagttttgtttttgctttttttgttgttttttagtttgtgttatttgttttttagggaggatcccagagcatatacctcttacctcttaaatgatgtaattgaattttcaaggagccaaatttcagatgaggatgttgctatgatcaataaaacgttattaatcgttcctgattcaaagccttattaaacacaggaatcctccggtggttttgtggatagcgttacccttttgagagttatgaggcagtggcagctccgtccctctggagcctttcttggcgtccccatcctctgaatgtgtgaatgaagcacaataggcatttgccgtaataatcttcttaggtaaagcccactggcatttcagtaaatcaaaccgcaaacaaattgctccagaaaatttgtgatccttctgctgaatgcaggttttcatttaaagtaggaaagcagtaaattcgcatcatgcaattgatccacactatgttggctatttcaactgtacctgttacgagtataatttaactctgcatgaacagcattttgccatgttgtatattactagtaacacaaaattacagtgttgctacataaaaaggaatatcctgaaaaagataaacttagcaacaccttctatttaaattcctggctttaaactaaagtttagaagcagtccccactttcataagcaggaacatgtgctggataagtataaatgaaggaaaaaagggacatatcaattataccaagaactatatcatgagccttttgttcatttgtggatctctgagctgcggcattggagccagcccatagttctggtatctaaatgtgtggcatgggtttagcctttggctttgcctcaggaaaaatcctttaacagctaaatctatataaaaattcatacctttcaattatccctgcctgagaatggctttgcagcaaggtgcccaagatcagaacaaggttaatgcatttaacatttttccaaaaaaatggtttttaaggatagctatggggaggtgtcatgagttgccttcttttgacaggcacgtctccaagtagccttcatatctcaaacacctacaacaaagaaaggtgataacgctcagatgggaagatgcaagtatgtgctctagaagtagacagtcatgtcttttcttcaggaattttaattgcaaaattgtaagaaaatattaagactactggtgataaattagagtttctgttgttttgcctttttatatgtaaggatttatgaaattgaattctgagaataaagctgtgttatattattataatggcatttctctcttggagctgggagcttaaggaaatactacacggataacaataatatgccaaatattcacatttttgcatagctttaaatatatttttttgtttacagtctttggtaacatacataaaacctgtattgttcacaacatatactctgtataaataataaagcacaagtttgtgtgacaaagacttataaggggaaacaaagagaaaacaccacggggtccaattttaaacttgctgttggtgatagttagaagtcattgaacatctagcacaagatatgaaggtcactgcatataacctagaaatctactgcatcgttgttctatgctgtgaagtagaaatactgagagaaacaaaattataaaactttgaaactttatgtcaacagaggaatgctctttgtgccttaaacacaaatttttttctaccctaaccctaggaaaatatccaaatattgaatgtttccagggcagtttggggccagtgtaaatgtagtcttaaaagtaaaacaatagcaacaacaaaaataacaaaagaccttaggcatggccacctaagtttccaatgtagaatccaaagctgagcaagattcaccaagccgtgtcctcaccatcacttttgtaaaccagaatgtaaatcaggcaagaaatttacaacagagaaatcatttaaatgtctagttcttgtagtaaaagatcttatgggagtatgagatcatcagcttagtataatcagatttgttaattatgtgttgattttgtgtttattcattttttgctcatttctttatatctccttatctctactctcctagtgatcacgtgagtattaatcaaagtttagtattagtaactgttataaatcatgtaatcttaataatgactaggtgtagagctaggtataccctctttaagtgtatcattttacatccacaaataataaaatcccagaaatgtaaaatatctactctataaaattattttatcaagagacatgctccactttcacacagttcacaaagcaaaggtttggttaaatgaggtatttaatattaatctttttaaaccggtcatgatattcaacaaagtgtatattttatactataccgaaaaactgaaaatctgacaaaaattttccactctggaaaggattatatataaatacttgaataaaattaagagcatatatgtgtgaagtagttgtgtgtatgtgtgtgtgtgtgtattgggaggatgtgtgtgtgtgtattgggaggatgtgtgtgtgtgtgtatgtgtgtgtgtgtattggactagcaatatgatggcccatgatcttcttctagttgaatgactttgtatgaacatttactttccgtttgggtcatattttaaatctaagaaatggggacaccaacatgggccttagtggcctcacaaagtcctcatgatctgaggtatgtgaatgcacagtgaaaattataaagtgatttacaattaattagctgcttttagaacctgatattaaaaagatagatggagagtattaatgaaaagagagagggagagttaaccaaaacactccacctgatttaattgtgtttttcacaatattaaactggtcagaggtggcaatctctgtcaatgggttgctacctaataacaaataaattatctagctggtttttcccctaaattgactgaaaagatgagttgttttggcaatatgtaaacacagccagagagaaatttaaccttccctaacctccattatctatctgaatttgaaaccaaatgcagatggagaactcattattgtagtgacaacctcggttgtaattaaaaaacatgggatctatcgctaaaagaggaatatagcaaagggcaaggaaaggtctggcccttttcatgcattatctccaggcttcttaccacgaaaatgtctcagctgtttggagcagatatattgacctatgactgactagctaatacaactatgacagaaatttttaagtgctattaattagccactggagtacaatagtcaaaaggtgaacactggaatgccaggatatctgtggcttcctcttacaaaactgcatcaacttcagcgtgctctgttaatggatacgtttgcaccaatgcaatatgactgcattaaatccatggtgccacctttttgtttggttttgtttgctttttgctgcttgaatgtatctactgagctgacattcaaataatagaggctttatatctcattttgttgcccagctgattagccaaaatctcatccctttcacttatattttcttggtgctgaatgacaatttcagactgggcatcagagtttttagtagaaggatgcggtggagtacgttttataacagataacctggatacaaaaacaaacaccaagtgaaaaaatattttttaaaaactgttaggtttattttgaaataaaaactaggacagaatacagacataaaggaaaacagtaaaatcaacagaaaaataaactctattgtactgaatttctctatcttgcagtctttgctctatcagattcaaaatcccccaaataagtaattttttaacagtatatgctacaggtcccctataatatcaaatcctctaatttatctgctttgtttacacaggacatatcatttgtatctacttaaaacttgtaagcaacagtcatagaaattaattacattccctcgctcttaaaatgacattttaaattcacctttgtacaagttggattttggtgcaatgtggacactatcttatgcctcatcttcatatgcttctcattttccctgttgaatggtaattccaggatccagatgccaaactgcgaaaatattcttccagcagcagcatatggttccttggcaagcttatctagcatctgtacaaaaagcttatagtttcctctgggtatgtaatagttctgcttgctaagaggctatttgtgcagtctttttctcacagacaccatttctcttgacaaacctttggttctaagcaaattttgtacattttttgtccatttgagaatcaatgatatacataagcttgctttataaccaggtagctatccaaatattctcactctatgaccagggggtgtatctggcactgacacaaattggtttaaatataataagagtttatttagctaccttgataagcaacattttgatactaataaaatatgaagactatctacattttggtagctatttgcaatgattatcaaggtcaagaggaagagcatttgaaatgaaagctgcacaaggtagcaatatttgaaagcgtatactggtgctcagcattcacactgttgtaaatggtttgtgtgatgtgtagttactcatatgtaacttttccctcactggaaattcagcttctgcacagctgttcacagggatcccctggtggcatatagtaccagtttctgcagcactattactgtggggaacagtttcattggtcaccattgtatctaagtactaaaaacaactgttctgctagaattagagattgttttatactgaagaatttatcagttaacttacggcagattaaaaaccaaatcttttgtggcttcttatagtcttcatatcctattactcttaagttctggggtatcttctaggaaaaaagtgacaaaatttgcgaaaagaaaatatcttccaacaagattcattttccctgttgaaaagctaaggcacagcaaaatgtatcaaaacatatcaatatctaagcccttatactacgtatgtggcgtttctggaaactagcattcttggtagtccgtgtcttcattgcatagtatttttaagactgtctcctaaaatggggcatcaggaatagagaagtgaagcatattattatgtatatgatctcctcatggatgattacatgatctgagatttctggctaacattttaatgaacttgagagaaaagtaaaaggagattgattgatagataaagctatattaaaagatgccatgcacatgtatcttgaatacttttaaaacagaatagtattactgacacaatattttacagagatcattcaaaataagtgaagaattccttagtcaggcaagcagaaatgaatttaaacaaagttaaacaggtttatttactggaggacatcctacggcctccaggatactgatgtgcatttacctaaaggaggatatgttccactcacacccttaaaattggactttttcttttttagcaattttactggaatgatgttgtacaaaacgcattttgaaaaggtctaaatctgcattttaaaaataaattatacaatatgattatgtcggcagctttaaaaactccaaaataagagatctatgacaaaatgcacttaatacaaataatatgggagaatccttatgtaaatgtagcatattaaagaattttagaaaccttagagtaaaaaacaactctaatgatacgagggcactatggtgaactagatgattgatgtcaaaaatttacaccttccagttccaaagatagatacatactgggtactatgaaacaaagacgttgtttaatatgtaaaataactgaaagagaagagaaggaaatcccaatatgtggatgtgagcattaagcacctaaaagagatgggaaaaaaatagtccacgggggtttgcaaagccagatatgggtagaagtggatattttagctgatttaatttttgttttttattattagtttatttcagctttcaaattattcttgagtaaaattttactaatgcataattttcttttaaatattgtctatttatattcgagtttgcacattcattagtacaaatttattcaaatattcaattttgatgttttaaaatctacattaggatgaataatttggagacagtataaattcactgaaaaactttgaatgggcttggcaaaaatgtcctggttctaaagattaactctgagaaaataggcaattgaaacatgtcctcaaactgtagcgacaatttgaaatagtatttcagaagggttggactggtaagaagaagttgagacatcattttctatcttatagtttagggattaaaagtcagagaaaactggaattgtacttaaggaattaggagcaagggagggaaaatttctcagagttttagttcttgtgactaggcctagtggagccaaaacgtactaggtagggctctaatctaaacttatctgaatccttcgtggtgaccaaagtataaccaatatccagcctgataggcagggaagttggcaagggtggagaaggagatcacagaccgagaccggctaccagcggcaatattgtgccaaagagcatgtgaactagagtaaaattttggtttcaaatctcagcccctgcgtgcatacacacatctgtgggaccttaatcaagtgtgtcttcctttctaaatttgagttcaggcttcataaaatggagataataattcagccttgtgaggttgttgtaaagagtaaattagatgatgcatgtgaagttcttgtcaaggacatagaaaatgttaaataagtatgaagattattgttattattagcattatttgtagtctgaaaaccacctaatgctagctctcagcaactgagggcacagtagagaaagaagcagcaatggattctattaatacatgttgtaatactgcaacatttggtttctataaatgaacccaatttcaataaacctaggaagacataggttcaagaaaaaaagaaaggaagcaatgcagatgacttttcctttatgccctgagtggcccaagatatgccaacattgaggccaataaaaaaactgtgcctaatgattttgaaggaaattaaaaaaaaaaaaaggatttaaaaatttttggctcaaagcatcaaaatcaaaatctttaggataatttgcgataataacttatttccatttcatcatgatttcatctacaaaaggaaaaggcagtctgccaaataaaatataatgatttctcaggctattgtttgttagtacttaagtggtataaaattccaatatcatagatggataattgataatagatatgtagataataacaaaaatgcctagctgtgtaggcaactgtattactctgttctcacactgctaataaagacatacctgagactgggtaatttataaaggaaagaggtttaattgactcatggttccacatggctagggggtgcctcacagtcatggcagaaggcaaaagaagagcaaagtcatgtcttacatggcagcaggcaagagagagcttgtgcaggggaactcccatttataaaaccatcagatctcttgagactattcaataccatgagaaaaagtatggggaaaattgcctccataatccaattatttccactgggccccaccctagacacatgagaattattatacttcaaggtgagatttgggtggggacacagccaaaccaattcagcaaccaatagtttggacaatcaggctcaataagcatatatctctttgttaattcatcctcactcttgaggcagacactgtgctgtttaattctttagtttgcccagattacccacgagggatgagagtagagactcttggttgtcaacctaatattcactgcctttttcttctagcccaatgattaatgataataataataataatgataataattaactactattcagttattctttgtcattttgtccatatacttcagtatgcctagctccattctcagtggtgtagattctgaatattcaataaggtctaatcatttcacaatataatttatattaatttactgtttgctgtctaaagaggcaagcttatgatcattctacttcagttttcaaaattttaaaaatgttggtcatatctaccttctgaaccttcatttgttttttttctgtttcttttagtttatttttattccagattctcttttatttttcatttgcctttgactggtttcattttctggatctgtgagaactttttgagaaagactaacctgtattgtgcagtactgataagtggttgtgttttgtttaatttctaattgtagtaaaatgtacacaacataatattttcttttttttttttctttctctctttttttttttttttttttttgagacagagtcttactctgttgcccaggctggagtgcagtggcatgatctcggctcactgcaacctccgcctctgaggttcaagcaattttcgtgcctcagcctcctgagtagctgtgattacaggcacctaaccaccatgcctggctaatttttgtatttttagtagagacagttttgccatattggccaggctggtcttgaacattttctatcttaaacatttttaagtgcacagttcggaagtgttaagtacattcacattgtcgcagaattgatctctcgaacttcttccatcttgcaaagttgcaattctatacccattgaacaactccacatttgaccttctccccagccactggcaacaaccatacactacagtttgcaacaggcagaattttagtattatttatctttctagttttattcccaagatatctggtatttattggtcttttaaggcaaaaaaaaatctattaatatttggctatgatagactggcaacagttcttggaatcacagattatttttgtaagttgtaaattttagcttaatatacataacttcagaaatgtgttttatggaatttctggcccttggacaattcgaataagaattatcagggtgattgtaagacgtgtagatgtttagctgtatcccaagtcaattataacagaaatgtctgtacaatctattttctccctggtgaagctcaacaatatgcaagtttattaatagtaccagataattcttaagcaaattaaaatgtgatcattttactactttatttactttcactatttactatttatttacttcactgttttattactatgtatttcaacagtccatattctactattaaacatacgattaacccaacaaacttctccccataatattgtttcacccataagtttgaaagggggacattgaagcttggagtaaaataacctggatccagatccaagccttggcaggtgaagctccttgggtagggcctacgattagaggttctctcatttgaaacttgggttaatgctcaatttagttagctggtcagcttttctcttctttgttagaattccattttgtagttaccccaacctatagcaaaatatttacctaaccctttatatcctggagttgtaatctgagtttgactgatgggattgggtatgaaggggaagggagacagttctctttttatctctttggctccagtgggaatgaacttcagtctatctgggttgaagactgagtctctgatagtgacttaagttcagaagaaagctccatatagaaattatgacattgacagatttgtgagagatatataccaaatctacttcttacccttacaaataagaaagaaacaaggcaagatatatatactcggaataaatattgaattaagtacacgtgcagcaaagtgttctatccagacggtttaacttgttagattgctctattcataagaattaaatgcaagggaacttcaaagagttcatggaaaatgtaattaaaataaaatacataaactttatttctcaatacaagctccgtcaagtttaagacgcttttgtaagtgatgttgccagacatttatcccatccctagagagccaagagtcctgggaatgtagccatgtcaatgtagtcattttaatattattaactgaagcaaaatgggtgcactttaggaaacagaagaagtcataaggagccaaatcaaggctattagacaggtgcctaatgatttcccattgaaattcataaaaattgctcatgttggatgcaagaaaggagcaggagcattgtcctggtggaaaatgtcccgggcgtttttctgctgaagctttggctaactttctcaaaacacactcatgataaacacgttatcattctttggcccttcaaaatatcaacaagcaaaatgtattgataacccccccaaaaaaaaactgttgccgtgaactttgctcttgaccggtctgtttttgctttgactggaactttttggtagtcattgctttgattgtgttttgccttcaggatcgtactggtaaaaccatgtttcatctcctgttataattcttcaaagaaatgcttcaagcttgcttaaatttccattgaaatctctgcttttgtctgcagcttatctgtggtgcaatggttttagtacccacagagtagaaggtttgctcaccttttatttttctcacctttcatgtcagatttgtgtaagctgagccacttgggatgtctatggtgtcagctgttgtttctgctagtaatcgtgggtcctcttcaattagggcatgaacaagatgatttttttttttctcacacattgatgtggttaatctactattgtgggtttcatcttcaacggtcttgtccctttttaaaatgagttatccatttctgaactgctcatttctttggggcattatcccaatacactttttgtaaagtatcaacgatttcatcatttttttcacctaagcttaccataaacatgatgttcgttctgctttaattttggcagaactcatgttactctgacaagggctctttctgaacttacggcttatcaatcttagcacctcaacctggaccctattgagacctgttatagcaagttagtatgaacttattttagtataaaatattgttgaaattcatgcatagatttttcataatacacatcttccatgaacattttgaaaggttccttgtatcctttgcacagattatagaagacttactacataagaattacataatgtagtaagtcttatataatcgtgaaaattgagctaaaatatattatttttccaaataaatggctgaagaaaaccaatctgcatgctaggaaacatttaaccatgtcacgacaggattttgtccttctagtttcaatgattttgtcttagaaattaaatattaaaacttagaagaaattcaccctttacttatcagttagtgtggttatactgtattctcccataatgcctaattagggtgacttgttttgcctgtgccttagtggtttcaatctcacccttccaagtacaatcaaatggaaaattttctcctgaaccttcctctgtaaagaaaaatgtcaatgtggcctagagcagtttggctgtggagttacattctaaggtggtccaggctcacacttagtcacttcagaagccactttcaaactgttattctggacctcaatgtagtgatttagttgcaggaatttagaaaacagtatgtaattctgagggctgtcaattatagcacttcatagaatacttaaaacaaaccgttatttatatgaaatgtttaaaagtctataacaaatgttttaattttattttatttgaagcaatatattgtatagttgaatctttatgagtgtgttcatatgtaagcatgttgtgaaattagaactttcactctataattattgcagttacctagtagtccttggaaacactaagtaacaaaaagctaagtaaaaatattttatttgaataaagatattcatgtttagtattaaatgtctgaaagaatttttaaggaaaactagacatataatcatgatttagataagggagagcaagcactttattaaacctgagaggtcaccctttcatattctacaaaggtgtataaaccaatcacatatagtcctagtttaggtaggcttataacattattcctatgtagtataattcaaatagattctttccaaggcattcaggcgagatgggtaaccagaaacagaggcaaaggatgatattgaatattttgacacacccacattccaatttcaagttgaacctcttcaaagacacagtgatttccaagcactgtattttacctgaatcaggaaaaagtacagtggaatgtaaataatgtatacttatttagaaaaacaatgtaaatactttatagactgttcagtaaataatgtatatacttagaaaaacaagataaatatttcatggactgctaggttactgttaaggttcagattaaacctccgggtttagagaacactgtgtttatcaaaactcaatttcttctacccaatagaattctaccaggttttggataaattgccatatacaaactatgtatttatgatacagttcaactatagtcactgtattaactgtacattatattttctagccgctgcacactaaaatcctgtgaacttcacagtttcagctatgttttattgttacaaaatgtacagaagtgtacttcttgtcaagtgctcgtcaaccttgccaatctctttatagattcatattatattcttgatcggttaggattacaatctcggttacctatttctaataataatgtttcctgttctcaacctttaagtccattatagaaactacttttattcctttctcctagcaaaattgcaccatgctttatgtatctatgttggctaataaggctttaaaacaatcttttcatttttgctttcttttaaatcacagctaaaaatgtgcctcacatttctctcctttcatactttggcaatatagcgcatctttgcagtcccacatttcatattcagtctctattgttaaattcctcataaagtgccagtaactgctcatatgttctaattaataggcatagagtgaaggccataaccagcttcacagaggagaacaatgagctcacagatcacagctgcaatccaccagaggttggatgtgaacattccctcctcaactgctgagtatttcaagcaggaggagcagctggcaggcgaacagaacccacgatgcagtaacagtttgttgaagccatgaaaaactgtagatgtcaaatgcatatcaaatagttctctataccaactggttaacattgtttggaccaaaagatactgaatataaaaatggagatttcctaataaattacactagtgtttagggggataaaagaataacttattggaatgcttagagtccaaagagtagtcttaaggtatttggggtaagagtggaaagaagtttaaagactagaatatgtgatttgttttgttatcatactaaacttagatgatgcaaactgtatcataacattggccagttatttggggtacagaagaactatgttccaaattcatggacatacatattcctgaagccagatggaaatcaaagaaatgcataatgacactgagccatcacgaagcctatgtgtgtttatcctaatctatacatattacgtaaaaacaattcaaagtgtatgctcttgccagtgtcatctctatgttcatgtgtttaacagatttacagttgacttcctgacaaagcttttgaaattgccccatgaggtgtgaatttataaacatgcgaatatgttctaagaaatcactggatataagatatgagaaaaagaaagtaaaagtgacacagtgatcagagattaagatgatgttataagaaaatttaaaaaattaaaaagtgaaagtatgaaaaagactacagaagacaaaacagtcatttcaaatgtacaagatgaacttacattttaataaatctgttgcttactgagtagaaatacaatatcttaaaatttttatttctattattcaaactgtcatgcacttgaagagatgctctaattgctagagtctaatccagggtttcccacacaccagaactcaagtttctaattcaaggcagtcagtgacagaccaggggcagagccacatctggaaactagacctgctggaggatttttaaactatattatctgcatcttattggcaaaaccgatgcacttcgcccatttttctaaaacaaggaagtcagtactgatgtacttaaaagttgcgcattgctttggaaattgcaaaatgttaacacacatgtgatttcatctgattctccaaataaccatacgagatagataggtgttagctccattttagagctgaagaaattgagatccagagggattacataatttgcttaaggtttccgtctagaaaaagatagtaatgctactcaagcctaaagcagctccttctaactaaaagaatacctttgctaaaattctaaaagaagaagaaactgcagatgaagcagaagcatacgtagaaggaggaggagaaagtttggggagggaggaaggaggcatagaaggtgagaaggaaggagagaagaaaggaaggaatgaatgaaggaaagaaaccaaaccaaaccaaattcttagagtggaaagagaaagttgagtgtctcagcactctgtaccataaaactcagggcttgacatttattaaacttttgggtatcaaaataatataggaactaaagtaaaaataaaaaactctttaacctatatttaagatctaagaatgtatttccaaattatattccactaaatactaaaggccagagtaaaaacaaaactggaagttacacaggatttttaataatgacctgaactcagaaaaacaatgatttcacatcttaagtagttttttttacctgtaatcacaagcaggcaaatatttaatttcactttattccttctagaacatccacttaaatatcttcctactgcaaatcaggcaagcaataaataggattagccagttttagttaagcaagacgtgtttaaaatacaatcagtgcttatttctaaaacagattattttctttaaattctgataatgggagtaaatgggaatgtttccactcatgatttttgcatctgcagcagtagaagctggcaatgaccacaaaagatcggtatccttttgacccaaaaatgtctctgctggtactctctggcccatttaggtgcttgctctatttggcaaattgtttaggttagccacatttgaactaaatacattgtgtgcaaccctgaaaagatgtgtgtgtgtgtgtctgtgtgtgtgtgtctgtgtgaagatccagtatattgttccatatctacccaattgtattctgattgttttctagtttgaacagcacagattagaaactgtctctggctcaattattagaatttgttaattaattaagtaaatgttgagagctgctaatactttgataagcattaagcaaaatttcccaaaggtttctctccaaagaatagttcatggaatcagaagatgttaacaaaatctttgcccatcacttactaactatgcaagtcatgtcaaataattgtttcccatccataaggtgggtttactgagcatcaattgctgtctgcactgtattgtaattaatataaaatgagatgctatttgtggaaacagtctctaagcaatacaatatttgtcaatagtcgtttctctcctgtagtgtatgcatttgcacctttatctacctgtcaatcaatcaggtttttgcatatcactttatttgttttgtggaaagaagatttcctcatgccccttgacattaagaatatctttggtagtttcttttgctgtgcagaagctctttagtttaattagatcccatttgtcaattttggcttttgttgccattgcttttggtgttttagacatggcactattcacaacagcaaagacttggaaccaatccaaatgtccaacaatgatagatttgattaagaaaatgtggcacatatacaccatggaatactatgcagccataaaaaatgatgagttcacatcctttgtagggacatggatgaaattggaaatcatcattctcagtaaactatcgcaaggacaaaaaaccaaacaccgcatgttctcactcataggtgggaattgaacaatgagaacacatggacacaggaaggggaacatcacactctggggactgttgtggggtggggggcggggggagggctagcattaggagatatacctaatgctaaatgacgagttaatgggtgcagcacaccagcatggcacatgtatacatatgtaacctgcacattgtgcacatgtaccctaaaacttaaagtataataaaaaataaaataaaaaaataaaataaaataaaataaaagaatatctttggtagtatttggcatgccagagccctcctgcatccttttttaagagctggcctttctttctgctttcagagtggctactgcttaagaattctatcacagcttttcattgctgttactgctgatgttaaactcttttgttttttgtttttctctttttttaagccttctggctctttttgtggatgtattgcctttcaaagatcaaaggacataatcaagtcagaataatacccatgaattacctctgatagacaataaggcattgtacacctataagatagggttacttcctatcagaacatgctttgcttcaggacttatggcttctaagtgattgctatccatggtctctttctgctaggtgctctggagctgcctcattagtcctgaaaagaatttttgaggacagggggagggagacatctttaaattcccatggctgaggccttactctattatgcagctacactcatgagtttaatgggaatgtacatacacatatttgtacgtatctgtacagacacacacacatatagcaatgtccatcagcaaatgctaggtataataaccaacaaattcattctttatgctctccacatggctttgtttttttaggtattgtttccttaggaggtattcgcctctgctttttaaatttagataagaaataaattataagtttgtattctttgaaacatcagtttagttcatttagtatctaacaaggattctttaaactaaatgtttagttattaaaagaaaacacaagtgaaaaatggattttgaaattcagttttgaaaacaaaaaacttgctgggcacgatggctcacgattttaatcccagcactttgggaggccgaggcgggcggcggatcacgaggtcagcagttcaagaccagtctggccaacatggtgaaaccccatctctactaaaaatacaaaaattagctgggagtggtggcagagcctgtaatcccagctactcgggaggctgaggcaggagaatcgctttaacctgggaggcagaggttgcagtgagctgagatggcaccactgcactccagcctgggcgacagagctagactccgtctcagaaaaaaaaaaaaaaaaaaattgttgagtatctgagaaatgtcagtcaaggactctaccatgaaactactagggaataaaggagagaaaacaaacagtgaaatggaatacactagattccatgatgggaatacaaaaatggacaatgatgggaaataaaggagacaggtcaagtttatctgaatgagtgtccccagaggcatctcagaacatggtatttttggtttaaatcattaaatgagtgttgcctaggctaccaagagaatgaagaaggttaattttgtaagagaaaaacataaagcataggttctggaatgagaagcaatttgaaaccaagcacacctgactatccagctatataagtctctctcttacagagttataaaattgtcattgtaagaattgattatagctattgagccctttcaatctgcctaacattctatgtgcatttagaatgccatatgaatcttacaatcacacatgagttaggccattcatttattatttccattttataggtgacagaaatgaggacagcaatgataataacatgcccaggattgcataactagaacattgctgaacaaagacttgaagccatgtagaacaaatccagagcctatactcttaactactatgctaactaggaagataattgcaagtttttaaaataattattattattattaccattatgcaatctattaaattacttaatattcaagacttcttcctagataataaattatcattctctccacaatgaacatttgaataatactttcaaatatatatgataaaacacttttctgattggaaaaactttgctaagaattactgtgggcttattttattgataaattaccacctgaggaaaggcaaacaccaaaatcagaaatggacatcttcttgcattacttgccaagctaagtctttttgagaaagtcaattacattctctgtacctgtgtatgtttcaaaaacttttgttttcctgtggagaaataaggaatttggtttcaagaaaggcttgttcagagctatcatgcttggtggcattacataaatgcacatttttatatattaaattagagattgccccaaagctgcacacattattgatttatcgggagatagagaagccgttaggccatcaagggtatcactaggcacatccctttcatgtaatgaaacttacattgggaaagtcaaggatccaaaaagagaagtctaggtgttgtggccagggggaaagactcagttcaaactgcatgttaattcctgctgagtaagctattgaagtggtaatactgcagaggccttgcctctggacttcacatttgtagctctcagcctagatgttcactacccatcaaggacattattcagccaggcaggctgcagcctctgtgctggcaacctcatctggagcagaactttaacagttacaggctctgaatactagttgagaaacaccaaaatgtcttctttgtgccaaacgtttctgtatcttccttaatattgtttctctgagcattatttattttgaatatcattattatcctggagttggtttttttttaagtccccaaattatcactttgctatgactgaaaaaataatagaacgttgtcttttctctaagtgtgcaagtctcaagtcagcagtgaatgctttgaaagcaaaaacagtagaaagcaaaggcttcttgatcatgctctatattccaagaatctaaacacaggccacattctcctttaaatataatttcaaagaaaaaggaacttcatttagcctctaatacctgaatcgatgtagttcttggaaagattcatggaccatacagtagtactcagaacagagtttacatcttggctaaaatatgtcaggtaaactttaatggggtaaagtcactagataaaaattctataatgtgattctctaaaattaaaactccccaaatttgattattcaattagcttatttctgagaaaaataagtattaatattttaatatgcttactctaagtgaacactcagaagcccaggaaaggaaaaaaaaaaaggactaacagattttgttccctgtttctcacacagcagtttgataccaaaatcaaagctggagtctatttcttataatttttacagcagtgttttcacttctgtacatttcaattcctctccttcctttggagtaaaccaatctctgattgcatgaaagatcttacagcgtattagtaagagcactgatacgtgaaattccaggtccagtcttactctggtgcttattagtaatcaaaaatggcacatcactaccttgtagataatacatatgtctctgtatttttaggttgtttatttatttgtaaatgtatggaaatgtttttataaactctgaagtgtgctgtacttttgaaataatatgattatatgaaatatttacatccttttatagtcccagagttagggcaatgaggtttttctctgattgtcaacctcttttttctctaggtttctgtgtagacaaaaagaggactgaaggattttagaggtcattattctttacatttcatacttggccttagggctccacattaaccttctggctcatttctttttttttttttttttgagacggagtttcgctgtgtcgcccaggctggagtgcagtggcgcgatctcggctcactgcaagctccgcctcccaggttcacgccattctcctgcctcagcctcccgagtagctgggactacaggcgcccgccaccacgcccagctaatttttgtatttttagtagagacggggtttcaccgtgttagccaggatggtctcgatctcctgacctcgtgatccgcccgtctcggcctcccaaagtgctgggattacaggcgtgagccaccgcgcccggcctggctcatttcttgttcaagaaatatttatgtccctgttaagtagtgagagattaatagtataaaaaaggagacacaaaacaacaacagaagtcttcataaaaccaaactttttattcagttgtgtacaatcttatggagtcttcatatattttaatggcttatagtagatataacagaatattagatttcatttaatattggaatgattagcaagtgactccatggagtgacttccctaagtaagacactgggccaggttccacgctgtgctgcacagaaatagttttataaaccatagaagactgacaatccataagaccgtgatacaatggccaaatgatgaacatgaaaatactgtagatgagttgacttctcaaggttccctccagtgctaaagccccaagattccttctatagtctacaaaatatgcaaaatagcaaaataaaagaatgaatgccctaaggttatctcagtgtttgaaaacacaaatcgtagatagcaaaagactttggggaatagataaaatatagagaggaaagatgaaagaattggtaagaacaaagaagtagaaagaaggaaaaccatggcaagtttaatgaaaagggaaaatgctaaatatttaagtgacaaaagtggttatagtacaaaacagaaaatacacattttaacaagtttttctaaatatccaaaaatgacagaaaaggtgtggagagatgatatgttctaacaaatcatcaatatttttcacaattgttattttctttctaaattctttagaaaataatgatatatttgatgaataaatgtaaccatcatatcttaaaaatctctatattatcaatctactatttatttaagaggttcaagtacacaatacatatttattccaaaccaaacatttagtcattttacagtatgaaggtctattagagatcatttcactcaatcttttaactatgcaaataagcaaacagtgacactttgagaactttatccaagaatccacacattggcagtggaagaaatacattaagagtaaaagacttaaaacctctggctaaatctcctctttctttctttgagttcagtttcaatacatggttttatttttaagagctttccttaatacgtgtgttttatagaatattacgtacctgacttagagactaatggaagagaggcaaaaaaccaagacagtccagaagtatcacacacacacacacgcacacacacaaacaaaaaacagagaaagtaatgatctttcatatatttatcacataaacaaggaaagaaaatggctacaagatacaaatcttggcatgtcaatccaattgaaagactgccaagatttctgctttcttgaattctgtcaagtttcttttttgctttcctctttagacaaagagcagtataaaactaccacatggaagtggttacattgtggcagtcctaatcaccagatatgtatccttcaaatcgtcacaaaagaatctccctgaaagagtcaaagaaagggtctgaggttatatttgactttaggcataggactcagggcaagtgcttaataaatactgtttcacagtgacttatgttgcagagagttaagtcaaaaggaatttgggagttttgaaataaaagtgtgttgcaatataaagaaacaatatgtatttactttttaaaaaggtgtatacaatctgtcttacaatatactctaccatggcatttaaattaacaaaagagattgagttttaaaatgaaatatttaataggaacaaaattttttaaatgggtagttaagaattcaaagtgcaatgttaagttaaatagatttgcaaacattcgtggttcttacaaactcttggtagttttgttttaagtgtagcatatgtattttataaagtatttaagttttaaactataaaaaccagtgaatcacaaagctatatggagtctatggggaaattcagttttatatttttatccataagcttgtgttcatattttctctgccagctcaggagtatatcaagtctgtgcctggctggtgagtttagtatctaattcgtagcaggtgctcaataaatgctaacttcccttctgttttttttttttaaagtcaatttcaagtcaaattcacacacagtaaaatttattccattcatatgtacagtttgataagttttgtcaaatgtatgctatctcaaaaccattaccaggctcaaaattggatcgattccatcacccccacccaaccaccacagcttcctcacactctttgcagcttctctcccactccagcatcctttgtcccaggcaggcattaattgcttctatctctatcgctttccctcttacagaatgtcaaataaagacaatcatggagtctgtagtcttttgtgtctgatttcctttacttaacacaatgctttggagattcatccatgtgatttgttcctttttattgctgaatactagtccactctatgaaagtaccacaatttatttttccattcaccagttgacaagcattttaggtttctcccagtttgaggatattatgaatacagctgtgatgaacattcaatgtataggtctttgtctagacctgtacaattcttaatgcaagaaattagggcttagaaaatgctggatacattacagaaaaacactggagagaaacccaaaagaacattttatatttctgtgtggagccaggtgtattagcaatgtagtcagaggacaccattccagaatattcttactctctcctttacttaatcatgtgatggaaattgtgagggaaattagaaaagtaaagagactggccagagcagtcttaaatcttttagccaactgctctattcactgtagctttgtcctctaataattgtgtaatagggaataatgatagcagcagtataattaggaataggaaaataactaacattaacataatgattagtatgtgccaagaattattctaagtgttttttccctattaaatcaattcattcttttataacctcttagtaataaattagtattgttattatcagtttatagaactaagacccagagaagacgagtgctttggccaagttcacatgctagtcagttgcaggcgggcattcagaaacaggtaggctgactccagaattagtgttcttaaatccattcaataccactttaatgaaataactattttattaacaaattgagaactttttaatgagtaccatttatgagagacacgaacaattctcaccattaggcagagcacaggaaatagaatccagctaagatgtgaaaacgatgttaacttcatcctgttgtctctaggtatactcgaggaagctctaccacatttctctggcatggatacatgcaaaagctaaagctataaatcttctttctatagaggagaaaaattcctctaaatgaaattcagaattaaaattttcctagttgtctgaataaaaatatattttacgaacactacttccttctgtttatatccatgtaaaactccgtataatatagtcaagagatcagttaccaccagaaaattatttttatatttaatattaaaaaataagtttacatttctatttgcttaaaaatgcaaagggaacaatagattaagctaggcttagagttttttgcttaaacttaggaaaaatttaaataagactatcaatattattttatcaaacacaaaaagagaatgagcaattgaagaaaagtggaagctggttttacaagaatcaggaaactctcatataatgagaactgattcaattctatagatatttcttataaacaactcataatatctcatcgttaacattttcaatacaaaatgacagttgcctttagttcatgaaggaaactctctttaatatgtttacaatggcttttattcagtttatctatttattacctagataagcaaatgagcttggctgggtaaaaattacagcacagtcactacataaaatcaatactgcctgttaagagttgagttgtgtgccttaaaatgatatgttcgatatgttcaagtcctagtcccggaatcaaggaaggtgacttcatttggaaatagagtctttatggatgtcatcaagttaggatgaggccagtagattgggccctaatacaacatgactgctgttcctactgtataaaaatggggaaatttgggcacacacacaaaagtggagacgcagagggtgaagacacagatgcatgggtcagatggccatgtgaagacagaggcaggattcgaagagatgctgatgcacctaaggaatcctggggtctccagaaactggaaaacagaaggaagtttcctccctgagcagcttcagagggagaacgtcccatcaacatcttgatgttggacttctagccttgggaactgcaaaacaataaattgctcttgttttaagcccctccgtttgtggtactttgttatggaagcccttggagactgtagaatgacaaataacatgatggatatcaaaggttttaaagaaacattctaaaatccctgctgcttcatactagtgatcatttaagtgatcatcaacatagcaatcgtctagataagttcagcaatattgttataaagagtcagccaagcagcagggcatcacataagagtcacattcttttgaaggaaaggcaagtgttttgatttctggatctcttattggatttacattaaggtccttgattttccaattttctataacatgaattgtcttgtctgatctgtgctgacatcgtttgctcattccaaggttatacaccactcgattgtgtcgaatgaaggtggaattgaagttgtatgcaggagaaaatcatttactaatgaacaaagaagttgaagaggttgtaagagaaaaaaatttcccatcaaaatctttactttgcccttttacttaaagagttggaggaaacagtcatgtcctgagggttgtccaatacctgatgaaagtaaagaaggtgaatatcaacattatccactaaggcccctgtgcatgtacttaaaacgctgttggtagaatttctgaatatctaaaatattccattcagcaatcactatatgtgaaaaaaagcagtcattgtatttatgttcaatattctgtggcttattaacttggcatcactcatctctacctttccctctgcccaaacttagaatcccaatggaataggcaccttcagattctaacaatcaatagcaggttttaaatatactatagtaataaacttggaaagcacatcatcagattggctaattcggggagactattttacttgcagatgagctagattcaatttgttacctgccaagtgcagcagctcaatactgggctggttattcaaggatcaggggtaaagtggcgctaaatgagccgagctgtcaacacattctctcactgcaacatcatcagcctttcctggcttgaaccctcttatcccaagtccatacgcacatcgttcttccatctgctagcacggcaggttgatgttacaacaaaccaattccaccccatgtattgatttacactctgtttctctagatatcaatctcagttaaatctctccttctgcctttttatcttcagtttgggcttaggtccttttatttgttatttttatgaaaagaaaaatttaaaggagcaggaagagaaatcacttgaaaatatgtgtttgaatatgcaaaacacagctagtttttaagtgaacacattttttaagttgacatagctaacaataaaacgacttactttttattcaatgccttcatgtaactttccgtacatggacggaagctctaagtggagaatagattccatggtggagattaaacctgagctgacaaactagaactactggaatcattgggtatgtcattttccccatgcacaatactctgcaacgatataataacacaggcacccactgacatgagatttctgtagcacctggactcaaagctgtaagacagaggtagtaatgacagttccatgattattccctttctggtcaatttcaatcagttccttaatgtgactttaatgatgttttttagtgttcatttatttttatttttttaacattataccaatagcagttcccttcaaccactgtgattttttcattaggatgattataatggaagatgactctcagcggaaatgtatgagacactcttgttatccatgcaccattgtcactatacactaattgctccagtctgtcatgtgaatgagtatttaaggagatttgaatccctgaaccaccacattcattgtaattctgtatgctaaagatccttatgaaattacagtgataaaattggtagcattgcacacatgcccagatctcctaaatttaagcatagttaaagcatttggatgcattttaatttgtaaataattgcttttacaataacttgatgtgtgctaagttagagtttggagtaaactttccagttaaactttcatgaatacagctaaagagaggactgaattctttggttgatttctggctctcatttgcaaaccatgcttcaattaagctcctagtatgggtagagagatatgagtaatgtccagctatcacagttccctgctcctatgagaaagatgtcaaatgcaccgaacccatcaagatagagatttaggtcattaactcaaccacagattggaaagcatttcaaaaagtgggtcagtttgtcaaaggtacaaacacgacatgacagagtcatttctaaaactgaagtgcacaattacaaatcacatcaaaagtaatcaatgcagttcattataaaatctgctgtttagggcaactacggcaaagttcaaaggaaaaggtatacttgtctctatctagggatgactaaaaggttagaatgataagatgacaacattatcaaagagttgtaaatatatgacatactgtgttggcattttaaaagtttttttttttttttcagcgcagcactttcatcaccaaagcaatggattttaaaaagactgtattaattagatgcaaatggctgcaagggaaacagaaccttttagtttttgagaaccagagtttaaatctgatatattgtagggtatgatatggaaaccatattgtcagttgcaagtagtgaatttgatgtacaatttctcaaagaaaggtcatttgagtcatcatgattgcaattgttttgaagcaactatgaagctgctggtgctaaatagttgagatgattggacttcaagcattgaaacatacaaatgcaatgaagaatgagtgccaaaagacagaaaatatacaaatggaagcagagtgaagttccaaattcaccttgaatgaatgactgattaattgtgaagacaatcaaatgaaatcattctataactatcttaaccaagagtttaagcaaggacgatttttaacttttagatctactttagataagttgataattatttgcatatgttaaagtctattgttttgggaatagcttgagtggaaagaactcaaactcaccttgagttctgtggataaatgaagagacacatcaggatgaatttgaagtgtcatttcttccacttttcagcagtttatcagagacagcaggtcagagttagcttaaggaagcagagtcaattgctaaaccctggtctatgaatgccttaccagcaaggcctagccttccagaatacgaaaattctatggctgtatagttacatcaaaaatttctatgttacagtaggtagcaagtcaggcatgagcagggcaggaaagagcccccccaccacacccccaccaggaatgtcaggcgaccatcaggtgatggtcaggcagtttttaagctgtttctctaaaataaaaattggtcacagccagcaccagggaaaggcagtctcccaatagatagaaaaaaacctgaaacctctgattagcagcttcccgataaaatctcaggagttagttgagtgagctcaagcatgcccatgaagaggcaaaatggcggagtttaactggtgtctgaccttcttctaggaatgctggattgttggggaagaatgcctcaagtgagcatgcatacaactccagtaaacacactgagcacgtgcccctccaagcgctggcaggccactgtgcatacataatgccagcctataagaccccaagtcaaaggtccaaccacacaagaacagaaatcacaacaaacagtctctcagaccacagtgcaatgagattagaactcaggattaagaaactcactcaaaactgcacaactacatggagactgaacaacctgctcctgaatgactactgggtaaataacgaaatgaaggcagaaataaagatgatctttgaaaccaatgagaacaaagacacaacataccagaatctctgggacacatttaaagcagtgtgtagagggaaatttatagcactaaatgtccacaagagaaagcagaaaagatctgaaattgacaccctaacaacgaaattaacagaactagagaagaaagagcaaacaagttcaaaagctagcagaagacaagaaattactaagatcagagcagaacagaaggagatagagacaggaaaacccttcaaaaaatcaataaatccaggagctagttttctgaaaagattaacaaaatagatagactgctagccagactaataagaaagaaaagagagaagaatcaaatagaagcaataaaaaatgataaaggggatatcaccaccgatcccacagaaatacaaactaccatcagaaaatactataaacacctctacacaaataaactaggaaacctagaagaaatggatgaattcctggacaaatacaccctcccaagactaaaccaggagaaagttgaatccctgaataaaccaataacaagttctgaaattgaggcagtaattaatagcctaccaaccaaaagaagtccaggaccagatggattcacagccaaattctaccagaggtacaaataggagctggtaccattccttttaaaactattccaatcaatagaaaaagagggaaatctttcctaactattttatgaggcctgcatcatcctggcagagacacaaaacctggcagaaacacaacaaaaaaagaaaatttcaggccaatattcctgatgaacaccaatgagaaaatcctcaataaaatactggcacactgaaaccagcagtacatcaaaaagtttattcaccacaatcaagttggcttcatcccaggtatgcaaggctggttcaacaaacggaaatcaataaatgtaatccatcacataaacagaaataataaaaaaaaacatgattatctcaatagatgcagaaaaggcctttgacaaaattcaacagcccttcatgctaaaaactctcgataaactaggtattgatggaatgtatctcaaaataataagagctatttatgacaaattcacagccaatatcatactgaacaggcaaaaactggaagcattccctttgaaaacttgcacaagacaaggacgccctctctctcaccactcctattcaacataatattggaagttctggccagggcaatcaggcaagagaaagaaataaagggtattcaattaggaaaagaggaagtcaaattgtcactgtttgcagatgacatgattgtatatttagaaaaccccattgtctcagcccaaaatctccttaagctgataagctacttcagcaaagtctcaggatacaaaatcaatgtgcaaaaatcacaaacattcgtatacaccaacaacagacaaacagagagccaaatcatgagtgaactcccatacacaattgcttcaaagagaataaaatacctaggaatacaacttacaagggatgtgaagggcctcttcaaggagacctacaaatgactgctcaaggaagtaagagacgacacaaacaaatggaaaaacattccatgctcatggataggaagaatcaatatcatgaaatggccatactgctcaaagtaatttatagattcaatgctatctccatcaagctacaattgacttccttcacagaattggaaaaaactactttaaattgcatatgaaacaaaaaaagagcctgcatagccaagacaatcctaagcagaaagaacagagctggaggcatcatgctacctgacttcaaactatactacaaggctgcagtaaccaaaacagcatggtactggtaccaaaacagatatacagaccaatggaacagaacagaggcctcagaaataacaccacacatctagaaccatctgatctttgacaaaactgacaaaagcaagcaatggggaaagcattccttattcaataaatggtgttgggaaagctgcctagccatatgcagaaagctgaaacttgatcccttccctacaccttatacaaaaattaactcaaggtggattaaagacttaaatgtagtacctaaaaccataaaaaccctagtagaaaacctaggcaatgccattcagtacataggcataggcaaacacttcattactaaaacgccaaaaacaatggcaacaaaagccaaaattgacaaatgggatctaattaaacaaaagaacttctgcacagcaaaataaactatcatcagagtgaacaggcaacctacacaatgggtgaaaatttttgcaaactatccacctcacaaagggctagtatctagaatctacaaagaacttaaacaaatttacaagaaaaaaaaaccccatcaaaaagtaggcgaaggatatgaatagtcatttctcaaaaggagacatttatgtggccaagaagcacatgaaaaaaagctaatcatcactgctcattagagaaatgcaaatcaaaaccacaatgagataccttcttactctagttagaatggtgatcattaaagagtcaggaaacaacagatgctggagaggatttggagaaataggaatgcttttacactgttgctgcgagtgtaaattagttcaaccattgtggaggacagtgtggcaattcctcaaggatctagaactagaaataccatttgacccagcgagcccattactgggtatatacccagagaattataaatcattctactataaagacacatgcaaacgtatgtttattgtggcactgttcacaatagcaaagacctggaaccagatcaaatgcctatcaatgacagacatatggcacacatacaccatagaatactacgcagccacaaaagaggatgagttcatgtcccttgcagggacatggatgaagctggaaaccatcattctcagcaaaataacacaagaacagaaaaccaaacactgaatgttctcactcataggtgggagttgaacaatgagaacacatggacacggggagggggtatcacacactggaggctgttgaggggtgggggtttaggggagggagagcattaggagaaattcctaatgtagattatgggttgatgggtgcagcaaaccaccatggcatgtgtataccgatgtaacaaacctgtatgttctgcacatgtacgtcagaactggaagtataatcataataataaaaaagtccaaccacacacttgatcttgcaaggcactgcttggccctcttccaagtgtactttacttcctttcgttcctgccctaaaatttttaaataaactttcactcctgctttgaaacttacctccatctctcattctgccttatgctccttggtcaaattctttcttctgaggaggcaaaaattgaggttgctgtagactcatacagctttcccacttctaacatacttttgtgcactgctcacttccacaaagcaaactttggagtagaacctctttctccactggccactgaccacctgatatgcaaggtttaggcccagcctaacacctttcttcattaaataacatggtctcaaggaagtgtgtttacttcgctacacctctgctatttccccaatacctcttattttacatatttatcttgtgtacagtttgtgtgtgtctgtgtgtgtgtgtgtgtgtgtattctctctgcagggcaaaatttaaccatttcttcatcctctgacgctaggctactgacatatgaaaacatcaatacttcaatgtaagtgtagacatgtttaatccaactctgcttaatcgcttataggctcttttcctcattgcttaaaagtggatctaaaacggcaagcgtcatgaattctcagaatgacactatagcaatttttgtttctgacattctctctcctctagagttcttcaataacctgagggatgttgatcgcaagctgttggaagtgaaaaacccatctgtaatgagagagaataaagaggaagaaaagagaaaagactttgatgattcctggattcagttttctccaaagttcgtttctctcctgcactttctgtttgttatttaagccaaagaggtgtgatgaaaatggggatatgcaagaatgcttgagatgcgtcctgcaagaggagtagatgtccaagtctttgtgccacgtatgtgtaggttgggaatggcgagggccagagggggaaacagcagtggtcctgggatgggagagaaatttggcaccaaaatgcggggaggaacatgtgcaaagggagccacggggaaaggcgcgccgcattcaaagaaccacatataattcattcagtgggacttaggcattgggaggtgggatctacggggtaggaaaaaataatgggtggaagattgcttactatgcaccaacactgctcttagcatatacatatattaggttcattttctctaatcatagcaacactatgaaacaggcactattatggtccctctgtttgggatattccgaggggtatgactcagtaactgcataaatagagtcaagacagaggtgcatctgctttttaataagctccactgttgtgggatttaaattagacagaagtttatgtaatttcatttttaaaagcactatagaaagggtgcatttgtttaaaaataaataacagcaattatgatgggaaagatgcttactcttgtttttcttctccatccctctcttccacgcccactgcatgggcaccctgcatgaaaaaatccttccacagttagacaatgtatccagcttttcatcatgtttaactaataatgagattattcaaaataaaaattgcttttatagaattctacattaaatttttaaacattttactcactcaggggaattatataatgtcacatatccgtacatttccttataatgattaatagtctggatacaaacttaaaacttaaaaataaaaatattaaaagttaaaattaaataattgtttagtggaaacaactcatttgatgaaagatatttcttaaacctctgcagcatgaactgtcctttggaggataagtgaagcttcctactaatgttcattctataggtgtttgtgaaacttaccaaatattcaaagtgcaaacacacacatctttgctctatcaatatttatagcctgaaaacacattattgttgcaaatatgtcaagacaatgaaaaatatccatttacaatgaggatatataacaaagggcagttgagcaatataatttatttctatcatttattgaatgactcataagtaataagaaatgaagctacaagtaagttatgaaggtcatctcctctcaagtatgaaaatacgtaaattgtttatatcgttatctgctgcaaaacattctttccattgaggattctgaaaattataagccagatgtctggactctatactgtgaaagtgccccaaattggctttcaataggacttggccatgtgcagattcctctatgcttcacagaaaatacagacatggcttggctaaatgtctgtgcttttcttaaagttatattaatgttatttgacccagctacagatggagtcagtctctgatataaaacaggtcagatcccaggagctattattatgatagaggatgccattttgttattatcattttacatatactttaagtatttaagaaattttaggcataatcttaggaatactatgtgtgttccttttaaaaagattctcacaaaagcattaatgttccattttaacacttgaagaaaacataggctcagaatgggttctgccattcaacctgccaaaagtcccagagctaggacgcagtttaaattcctggatttgtctacattcacctgcattatggtttctctaaaaaagaagtaataataaaaatcactaacacctttgaacattataagcattttacatgaattgttacatttaatcctttcaactatccatttaagtaggtaattaataagcatattttacatatgagatgactgaggcttggggaagctaagaaattcttcatacgtggcaaagatggactttgaaattagatatcctttattctagagcctgcaatttttaaacaatgcattgcagagagagcaacattgttatccaggccagggtttctcaactattaatgggccacagatcaccttggtatattattaacatgcagattcttgtcccataggtttggggtgggtcctgagaatctgcagtttcaacacactcccaagtgatgccaatgacccaggttgaaggggtggcctgcccctccacacctgtgggtgtttctcgtcgggtgggacaagagactgacataagaaagagacacagagaaaaagtatagagaaagaaaaatgagcccaggggacaggcgctcagcatacagaggacctgcgccagcaccagtctctgagttccctcagtatttattgatcattatctctaccatctcagagaagtggatgtggcaggacaatagggtagtagtggggagagggtcagcagctaaaacatgtgaacaaatgtctctgcgtcataaacaaggttaagaaaaaggtgttgtgctttgatgtgcacatatataaacatctcagtgcattaaagagcagtattgctgccagcatgtctcacctccagccctaaggcggttttctcctatctcagtagatggaatatacaatccggttttacactgagacattcccttgcccagggacgagcagcaggagacagatgccttcctcttatctcaactgcaaagaggacttcctcttttactaatcctcctcagcacagaccctttaggggtgtcgggctgggggatggtcaggtctttcccttcccacgaggccatatttcagactatcacatggggagaaaccttggacaatacctggctttcctaggcagaggtccctgcagccttccacagtgttttgtgtccctgggtacttgagattagggagtggttgtgacttttaacaagcatgctgactccaagcatttgtttagcaaagcgcatcctgcataaccttaaatccattaaaccttgagtccacacagcacatgtttctgcacagggttgggggtagggttacagattaacagcatctcaaggcagaagaatttttcttagtacagaacaaaatggagtctcttatgtctacttctttctgcatagacacagtaacagtctgatctctcttgcttttccccacaccaggtcacctactatttatcaccggatggtttttaatacctatcaatgacttagagatgtttttccctctaatttcattttcaagtaagcttttactttcctttctctctctcactctctttctcctctctctctctcaatctctctctgtctctctctcatttaccagtttatgccttttcttctcctacactaacacctaaatcatttgagtgaaaatttttcacttgaacaaatgatattgaggaataagtgagtacttccatatttgattgtatgtaattgtgattgttcactaatgcaatctgagtggagaaggccccggaagaggcccacacactaatctctgcaacctgtaaatatgtccagttccatggcaaaggagaattaagtttgcagataaagttaagaataattatcggctgactttgagatggggagaagatcctggattatccaggtgggtataatatattcaggagggtccttattagggaaagagggaggaagagagagagagaacaagagggaggcagggtggaaagatcacagcctcctcttgctggctttgaagatggtgggagagaaatgcaagcatgaaatgcaggtggcttcgagaagctagaaaagcaaggttgtgattcttcccaagagccaccccagggaatgtagccctgctgacatattgattttagctaaatgtatccatttcagacttctgagatccctccaaaataataagataataaattcttcttgttaaatgtactaacttgtgataatttttatagcattaatagaaaacaaaactctaaggtattacacagtctagaattgaccttagtgaaagctgtacgattcaagtgactcaggtctctctacaaggcatgcatatcatttgtatgcaggaaaaaaaaatgcattcacaaagattcctatctgatcataaataataatctttttttaaaatgagaattaccactgtcagctagatgacacacttttaactttctccatcatgtcaacaaaacacaaaataaaatatatttaaagtagagtaatattaaaatatatatatttaaaatagaatatatatactctgtgttctatttatatattgcctatatagatatatatttaatggatatcactgggttaaaatcaatatgtcagcataactgcattccttagggtggctcttgagaagaatcacaaccttaacttttctagcttctagaagccacctgcatttcatgcttgcatctctctcctaacatcttcaaagccagcaagaggaggttgtgatctttccaccctgcctccctcttgttctctctctctcttcctccctctttccccaataaggactctcctgaatacattagacccacttggataatctaggttcttctctcaatctcaaagtcagctgattattatccttaactttatctgcaaacttaatcttcctttgccaggtaacctatatttatatataagggcaacagtaaagggaaagaaacaaagagtgtattgtaagcataaaatcagattgagagtcaattgactctcaggagagatatggctaacactaagctttgttgtcttcgccactgaattgcacatataacgcttggaaaattactgtgtttttctgcctcatgtactccctttcctggaacccaggaggaatcaatccatccttaccccatatgaggaattggaacaaggtgaaatggatataataaggcttgtacttactaaattttgtacagaatgttcctgctcaatggagtcaggtatttacaatctcttgtcaccctaaattaacaaaacgctatctttacatttcaactttgccattttaaattttaaagggcaaattgtgtttcccttgtgacctaatcattttatatttttgtagagacgagatctggctatgttgcgcaggctggtctctaacttcaggcgtcaagcaatcctcccacctcaccctcccaaaatgctggaattaaaggtgtgagccaccacaggtgaccctaatacttagatataagttcaggagaagcctgactctcctcacttatctaatgggtctgagttcaggacaccatttaatgtaacacatggacacagtgaataacctcactctttgttgtcttgattgagacctagggtctcttaatgcaacactggtattttttctctttttaaaattccatgcagatgagtagatgagaggattctcaccctgcccccccacctctctttcccttcttcctttcttctcacgcagatatattttactaggcaaagcattccatgacattttattaattataacaaacagcttttttatatctaatttttattgtcatacttacatttatctatcaaatgttggaatactatagaaagaggttacaatacagaattttgacattactagttacttagccccaatagcatcataataatacaaaaactcaatttaaatcataatattatggagcattttacagccgttaacacttaaaatatttttaatgtgtgtgttatcataatggatatcatgccaccagataacttaaccattatttagtggtgaacggaatcacatacatgtcaaacaacaataaaaattgacagtagtatgaacgattatcttctctaagttattttgaagtatatacatgctctattctgtcagtaacttctctgaacatttcccagccttaagattttcttgactgatcccttaccctcaattcaatatctgtgattaaattgacccttttgatcagtttcaggcttgtgttcaagctaacaactgtgtgtgtcagtcgccaggtttccaagttcaaagtcattctcccaactcagctcacaatcatgtcctgctttgttttaaacttgcactagacttaatgccatttgatattaggttaagtgtgtgaagactgaataaaggctagtaaaattgagttttttgatgctattgtaggatgaaatattccaggtagtatggaaggacagaaatacacagcgtcacctatggatatagcaacaaaatttggcttgcagcttccaagagagttaatggaagagaaataatagaaaagccagtagacaagaacagaacttaattttcctgtgcaggtaagtagttataatgtatatgtgtgtactacttacatgcccccttgtagattggcaaatagactaaaaaccaaaaatccatcttattgcattgataatatatactatacagcttttacactattttgctgagtctaaacttaggtaagaaaatgttaccttggggaaagtagctagatatatatatatataagtagcggtactgatgtcatctatatcagggaagacagggtagctgcatgtgggaaagtagacaagctcctagctcaactttccttggagtcttgtaacatttgcaaaaatttctccctggaaaaattgactactgatacatacatttccaccattccttttataaagaaaacacacgttacttgacaattataaaattaactagaattatagaaatttatttcattatatagtcagaccatctaaggcaattttgataatttgtttacactaacttcatatattttgaaaaatggtgtagaactatatctgaagataaaacatttttctcttccacatctctacatctgcctataattttatatcagttagcaaattcagatctcaaaattaaggtgtgagaatcaagttaacccttaaaccacacaggggttagggacaccaacccctgcacagtcaacaatccacatgtaacttttgacttccccaaaaccttacaaatggcctactcttgaccagaagccttactaataacataggcagtggattagcatgtattttgtatgttatatgtattatatactgtatccctgcagcaaagtaagcttgggaaaagaaaatgttattaagtaaatcataaggaagagaaaatatatttactatttattaagtggaagtgaatcatcacaaagatctacatccttgtcatcttcatgttgagtaggctgaggaagaagagaaggagttgatcttgctgtctcaggagtgcagaggcagaagtgaacctgagaatttcaaacccatgttgttcaagggtcagctaaattgcatttctttaggtttaaaaaatacacattatcgataatcaaagccactgtctgccttctacaccccaccgggattgtaaaatggccatatggagttacgtttcattggttgggggtgaggggctttgttctttggttgttagtgtggcccttaaagtcttcttccatgacacctcgggatccagggctcttggatgaggctggatattcctttttctaattggatctgagtgtctgtccctccatttctatctaaagtcttgtcttattttctcctacctctatgaggaagcagagacagatcctggaagacattcctctgtcttgtctcttgaaatacaatagctgtctttccatttcattgacctcaaatattttcttctgcacttctctttagacccatttagcttcattgtctctttgggatttggcttttacaaaatagtggtgtcttaatgagtttgggctgctgtaacagaataccacagcctggatggattaaccagcaaagatttatttctcacagtcaggaggctgaaggtctgagatcaggatgccagcatggtggggttcctgatgaaggccctcttcctggtgatgtcctcacatgactttccttggtatatggatgcagaggaaaagacagatcccttgacttctcttttttaaaaaaattcattttttaatggaggtaaaatatatatttacggccaggtacggtggctcatgcttgtaatcccagcactttaggagtctgaggcaaatagatcacccgaggttaggagttcgagaccagcctggccaacatggcgaaaccccatctctactaaaaatacaaaattagctgggtgtggtggtgtgcacctgtgatcccaactactcaggaagctgaggcaggagaatcacttgaacctgggaagcagaggttgcagtgagccgagattgtgccactgcacttcaacccgggtgacagagagagactccgtcacaaaaaagaaaaaaaaaaaaaaaaaaaaaatatatatatatatatatatatatatatatatatatacacatttactcttaccatctttactattttcaagtgtacaattcagttgtaataaatctcctcttttactgagggcattaattccataatgagggttccaacttcataactgaatctaaccctaattggcttccaaggtcctcatctccaaataccatcacaatggagattagagtgtcaacctgtaaacttggagaggacacaaacattcagtccacagcagaggccaaaccttgactttggactgcaactccattctgcccgcacccccccaaaaataattctctgaagcaatgaagcctaaaaccaactataatttgtagaacactggagaggacaatacaaagaccaaagaaacaaattaccattttaataaattactctgtaaccattttagcttcataaactttttgaagtagatgttatctggatatacatttaatacaaaatgggcatgattaatagagaaatttcaaattttaattcacacaccagtcagcaggaagtccttcaaaaaaattcaggatataaactggaacattttgaacatacagtctcctccacacccttatttaggagtgacagcatttttaatattatgtgctgatttcatataaaacactataacactatagtatgcccagtcaaccagaaactaaataaaaatatataaactcatattttacacaacgatgaaaaacaaggttatcaaagaagttgtgttttctataaaataagaaaacacatttccctgactaaaaactcagaagcattgatctattattttgttgagatttgaaagtctcattctggctgtgattaacactctcgcatataacaagcaacaccttaaaaagaaagcctattttcctttttttctcctttttcacaacattgctttctcttaagtaccacttaaaattcaagtagggtttttttttatgactaaggtcacattataaaatagcatataagatgaaagtaatagagtgtagccaaagaggggcgtgaaaatgaacacatcagaagccagtgttgcttgggcgcagtttcagaggtgttcattttcattggctctttaaggtaggctgacaggaacaatcagttgcctcatagatcactgacagaggctcaggaagacagatgacaggcagaatagcaaaccccacagaaattaaacagagtgctggaagaacaattagcatcgttggggataaaaatgccaaggaggaacgctgctaattttagggcacagaaccaaacctaaatgacatcttcatctcaatggctgttaagcccacaaaatcagtgcagcaattctaactacaactctaacaatgtgtttttatataatttcacattaggtggtccatgtctgatcagttacaggcagatatactcgaccgtttcaagatttctcataagttttatgtggcagagataatttaagacctcatctcattccccgacaggaaattcagcgtgccaataagcaattggactaactcttcttggtgagtggagtcaggaagagttccattccctccacctacagccaggcctcgacagctggagtgtggggtttgaaagctttagaaagctcctcgaaggattaaacatgaaaaaacttggggtttagcaacatggaaaaaggaacacttttgtgaagaatgtaccccatcctggcacagaactcctcaacccaaatgagttgggggtaaagagcatcaaggccatgaagagacatggcttagatgctgaaaagaagcttgttttatcttagacatgctacctcatcaaaatttgagtgtttgtcatattttcccagtttaaaaaaaattttgaaaaaaaatctcaaaactacagaaaagttgaaagataatatgatacaaaaccatatgattatcaggctcacaatgtttgcaccataattcaactttgtatttatatacaattaataaaaacagtaacattttgaagaatgcctatcttgtgtatataaatttatactgacagactccactcaactcagtattttaaaatataattacatttccagatgttttaacattttttctttatgataatttgtgctattattttctaatccaattccatacttgaagtagaaacaaaaatacatatctactgggagccttaaaaagagggcagggtaaacagtaaagtagtctcataaaaataatataaaaattatacaaaaattaaattgatattatgccataatatgatataaatatataaaacaaaagtttttaaataacagcatttaatatactactgattattagaaaaggaaacaaaagacacatcactgaacctcatttcctataatataagaataatctaatattcacatgtttcagctaatgaatatttttataagaaaatatctatttcatcattctctataccaccatttgcatgtagatttttgcaaagtgtaacttgaatgtcctcatctccacatttccagtgatctaccagcatgtaattgaaagtgctcagcttttagcccccatctaaagctatagcatattccactattttatatgaatattttaatacacgaacatcttcaaacaatacttaaccatattacatatactcaaccgtattacatgaaaataaattatcagttaattactggattaagtttggaaattcagcttgtctaaaagaaaagtttctgctttgcccaaagaagtaatttgtatattttaatgattgtgaataaatataattttatagcttttagcatgtgagtgaagtttgagcatctttgctcaagcatcagctattcaaattttgtgcaagtaagaacagcatggcccaaactctatcacaaacactgatatgccgtggtctaatttaaaggatctttttttaaccaaaaccttgatttgtccagatatctattcccagcatcctttaacctcctcttatcaactcttatacaactcacatctgagtaaatttaaaaagctaatccagagaacatcctgttacttcaagatatatatgtagaaatgatgctttaggacctgagctgtcacgtgctttactcacattaataggtgcttgtcacttagcaataaaataatttccctaccttgtcactgaatgagataaacaactttgttttccagttatgattctcccaattcatggtcggaaatgaataggttagaggtagagtaagcataatcatccatgcccataattggaagttgatatggtttggatctttatccccacccagatctcatgttgaattgtaattcccagtgttggaggtggggcttggtgggaggtgattggataatgggagtggtttctaattagtgccatccccccttggtgctgtcttgtgattgaattctcacaagatctgattgtttaaaagtgtgtagtactgggcaaggtggctcatggctgtaatctcagcacattgggaggctgaggcaggcagattgcctgaggtcaggaattcaagaccagcctggctaacatagtgaaaactggtctctattaaaagtataaaaattagccgggcgtgatggcgggctcttgtaattccagctactcgggaggctgaggcaggagaatcacttgaaccctggaggtggaggttgcagtgagctgaggttgtgccattgcactccagcctgggagacagagagagacttcccctcaaacacacacacacaaaatgtgcagcacctcccacttcacattctcttccttctgctccagccatgtaggacatgctggcttccccttcgccttccaccatgattgtcagtttcctgaggcctccccctccatgcttcctgttcagcccgtggaactctgggtcaattaaacctcttatctttagaaattacccaatctcaggtatttgtttatagcaatgcaagaacagactaatagagaagttcacaaaagaaagatgattttaagggcacaacagatattggcagaggtgagcatgagaaggggacgtgcaggatcctctataaagtaacccaggcagatggaattgtcagaagaaagagaaaccagagaagcttttgctgaatgtggaagcaaactgggagaattaggaaacaaaattcatttacggtgaaggagtttcaacatacaaatcaaagatacctgctagattttgatcctgcagggacttaaagctaaataaaaacactaagctcaaaatttccctgggggagaatattcaaagctgaggagacagataagactaagaagagcattagctaggccagaaagatagatgaaacttgctcactctgaagattcttgggagaaaatttccactggaggggaaagctttgtcaaatataccactggtttcccactcaaggaacatgggcaggactctgaagcctcaggaggatgggggtacagagcgaggctctacattccaaaacaccaaactgcatctcacaccagagccaaaggcgtgccaatcaaaattccaggagggctacacccaagaaacagaaacaagccaaacgcagactcactctaaactacagccacagctccttgacctggttcaatgcggggttacatttagctttaatcactgtttctgcctgacagagcagagaatgttttcaggcacaaaggaaccttctctgaggctggaaatgttctttatcttagtctggggggcagttacaagtggtagtacatatacaaaatgttttcaagttaaagattgtgtgtactttcctgcattatgttatatcttagttaaaaagtataacaataaatcccggcaatttgggaaactgaggcgggtggatcacttgaaggcgggagtttgagaccagcctgaccaacacggagaaaccctgtctctattaaaaatacaagattgtgcctgcctgcagtcccagctactcataagggctgagaaaggagaattgcttgaaccctggaggtggaggttgtggtgagccgagatggcgccattacactccagcctatgcaccaagagtgaaactccatccccctcccaaaaaagtataataataatacccataattattaagcacaaatctgtcatcctcaacaaagcaaaatccttgaaaataacctatatctaaccgcaccactcctcatcatttcaacttctgcctcacctgctcaggcctgaatcccatgttcaatagtctcttgctttcctttttatatagttcatgtcatttcctatgcataagttacaaacttagggcagttgtgatgctctgctttttatatgagacaccccaattagtttatttctccctaagtgtcaatattcttaaaagtagtgtgcctcaagatcaatgacctatagcaattaaccctggtggccatttattttatggatagacttgtttacttgaaatagattttcaaggccaattttttggaatgcttcccttttggaaaaattggagcattctttcttgtcccttttttctaaattgttcatttgtactataatgatcttagattggttctgattctgattccctcactctgcaatcttatttcaacacattatttcattagtttgtatttgaatacaatgatttactgaattcatttaatttatctatgaaataaactacaactagggaatctgcttctgttttttgaatcatgctttctcttcttgattggatttctcagttgcattttgcattcttttttctctttcttcctcaccctcctctttcctctctacttccttttctcctgttcttgcttctccttctcctcctccttccaccatctttttcaataaatttgcatatatttccatttattcctttgtcctttaagtttgtcatgggtgtagacattgttttcattgaaaaatggggaaattcttcctgatattattaccattttttctgggaccaggttcttctaaccattaaccctcagtttcagttttactttaacccgtttttctttagaccaagtctcttgggatcataaagtagagaactggcttgaactgggagcgatccattcacaagcatttgagcatgcctcttttctgtcatctccttgaatgcctatgcctaggagccactccagcaagccagcgttgtagctcatacctttcagtcttagctcattttcttttctgtatggtgcactagaatatgggaatccctgaaatatgacaggacctgaaacattgcaagccctggagtagcaggaagacagatgaataacagcccttaattatggcaggccctgatacagcaaaatcccttgaagccatgtctacagaaacagtgctactctgtagatgttttgattatccacaattgtcccctcatccctcagttataattataaaaaggaaatagaataaatgtcaatatcatttatgaattaaaaacagtgtaatgttaccaatgagaagagagaaattatatgaggaattcttgttgcagctttgaactagttcaacatatattttggttattcagaggccatggctgaaacaaatgtaccacttggttgtttttgtcacaagtgtttttgatgaggcaccagcaaagtctattttgttgagaatttttgcaaatgtgttcatcagacatattggcctgttgttaccttttgttgttgcatctttgtctggtttcagcatcagagtaatactggccttgttgaaaggctttgggagtacttccttctcctcaatttttttgaacagtcttagtggaatttctattagctactcttttgatgtttggtagaatttagtaataaagccattgggttctcagcttttgtttgaggaaaaccttttttttttttcttatcttgatattggtcaattcagttttttatcttggtattgttcaattcaggttttgggtttcctcatagttcaattgtggtaggtggtatatgtctagaaatttacccatttcttctaggttttccagtttattggcatacagttgctcataatagtctctaatgatcctttgaattgtggtatcagttgtaatgtctcctttttcatctctggtttgatttgggccttttctcttttattctcagtctggctaaaggtttatcaattttgtttaccttttcaaaaaactaactttcattttgacctttttttttttttggataacagagtctcgctctgtcgcccaggctggagtgcagtggcctcggctcactgcactgcaatctctgcctcccggtttcacgccattctcctgcctcagcctcccaagtagctgggacttcaggcacccgccaccatgcccggctgattttttgtattttttttagtagagacggggtttcaccatgttagccaggatggtctcgatctcctgaccttgtgatccacccgccttggcctctcaaagtgctggaattacaagtgtgagccaccacgcccggccaaccttttgtgtttttttgagtctcaattttatttatgttctgatctttatttttttctattaattttgggtttcgcttgctcttgcttttctggttctttaggattcatcattctgttgtttatttgaagtttttctacttttctgatgtaggcagttattgctataaatttccctctttgcactgctttggctgtgccccatagattgcgatatgttgtgtttccatttttatttgttttaagatgtattttaattttcttcttttatttgacctttggtcaatggtcattcaggagcacattgcttaatttctatgtgttggtatagtttctgaaattgctcatttttaatttctagttatattgtagtcagaaaaaatacttgatatgatttctgtttttcagaatttttgagaattgttttgtggcctaaaatatggtctatccttgagaattttccatgtgctgaagagaaaaatgtgtattctgcaaccgttgagtgaaatgttctgtaaatatctattaggtacatttagtctatagtacagattaagttcattatttctttgttgatttttttatctagatgagctgtccaatgccaaaagtggggtagcatgttgaagtctccagctttaaccaaattggaatctatctctctcttaagtgtctaataatatttgctttatctctctgagtgctacagttttgggtgcatggatatttacaattgttacactctcttactgaagttattgctttattatatataatgacattctttgtcacattaaaatttttgtcttgatctattacatctgatataagcatagctactccagctctttttctgtttccatttgcatgatttttttctttatttttagtctatatatatctttatagatcaagattcatacagacaccatttagttgggtctttttttttttaaatccagttagccatgctgtcttttgattggaaaattagtccatttacgttcaatgttattattcacaggaaaggacttactattaatattgccattttgttatttgttttctagtgggtttcttggtcctctctttgtttcttttttctttccttcctgtctatcataataatggtttttgtctggtagtatgttttaattttctgcttttatcttttgtgtatctgttattgtttttcattttgtggttgctgcgagacttgcaaatagcatcttataaccaattagaatggtaacttaagtttgattacaatgaaaataacaaagacaagtaaagagaaaacaaacaaacaaaaaccctctacattttatctccatccctgtcctcactttttgactttttgttctagttacattgttttttgctatttcttaaaaagttgtagttatcattggtaagtttgccttttagtcttcctactaaagatatgagtgttttatactccaaaatgacagtgttagagtattttgtatttgtgtacttactattacttgtgaattctataccttcagatgatttcttgttgtttgttaacatccttttttctgatactgaagaactcacttcagcatttcttagaggactggtctagtgttaatgaaatccttcaacttattttgtctgggaaaatgttactccttagtgtttgaaggaaagtgttgcttgacactgtagcaggacaagccacagacaaaactcctcagacactgagttaaagaaggaagggctttattccaccaggagcttcagcaagactcacaactccaaaaaccgagctccccgagtgagcaattcctatcccttttaagggcttagaactctaagggggtttgcatgagagggtcgtgatggattgagcaagcagggggtatgagactgggggctgcatgcaccagtaattaaaatggaacagaacaggacagggattttcacagtgcttttctatacaatgtctgtaatctatagataacataaccaattaggtcaggggtcgacctttaattaccaggtgcagggtgtggcgccgggctgtctgcctgtggatttaatttctgccttttagtttttactttttctttctttggaggcagaaattgggcataagacaatatgaggggtagtctcctcccttaacacaatattctaacacaatattctaagttgaactttattgtgtgtgtgtgtttccttcagcactttgaatgttattctactctctcctggacagtaaagtttttgttgagaagtctgctgccagatgcatcagagctcctttatatttatttacttctttgtgctgtcacttttaggatctttctttatccttggcctttgagagtctgaataatatatgccttgaggtaatctcattttggttgaccctactttctgttctatgactttctgtacctgaatattcatacgtttctctaggtttggaaaattatgtttttatttctttgaataaactttcttctccaatctctatgtcctctttaaggccaataattcttagatttgcccttttgtggctgttttctagatattgtaggcatgctcatgtttttaattgtttttcttttttctcttctgtgtattttcatatagccttcttcaagctaacaaattctatttctgcttgatcaattctactgttgagagatgctgatgcatttttcagtttattgattgaatttttcaactacagatcttctgattgatttttattatttcaatatctattaaatttatctgatataattctgaattccttatctatgttatcttgaaatttattattaacaagtggaggtgtaaacagaccaaagctgacacctccagaaatgactgagtttcggccagtcaaatgtagccaactgtttgaaacatattcaaataaggcaaaaactgagctgtaaccaattcagctgtttctgtacatcacttccattttttggatatcactttcctttttcggtccataaatcttcttccaccaaatggctgtgctaaagtctctgagactaccctggctcagaaggccaccaaatctgcaaatcactcattgcaaaattaagctcccttaaatttaatttggctaaagattttcttttatctttttatctctgtcactccaggattgattactgggggagggatgctgtagacaatgcaagaatgtattttctacccacttcaatgcctctttttttgatactatgttaaaactaggtactgtaatcgctcacctgattttctggttcttttgaaggtaatttcttgcatacatagttgttcaattttgtgttcctgcaggggaacaactgctggatgattctattttgccatcttctttctagaattattttcttactaaatgcttgctgctttgttatcatttcaaaaatttagctttatttagtcaaaagtcatgctttacagttgacccttgaacaatacaaagattaggggcactgaccacctacacagccaaaagtctgtgtataacttttggccccctaaaaagttaactattagtagtctactgctaaccagaagcctaactgataacagtaaattaacacagactttgtatatgtattatatactgtattctttataataaagtaagctagagaaaagaaaatattaagaaaatcataagaaagtgaaaatatatttctatttattatgtagaagcaaatcactataaaggtatttatccctgtcatcttcatgttgggtagactgaggaagaggacaaggagggagagtttgttctgctgtctatgggatggcagaggcagaagaggtaggggaggtgaaagtgaaggcaagagtggtagatacactcagtgtaatggttattaaagaaaattctgtgtactggattaagaaaatatggcacatatacaccgtggaatactatgcagccataaaaaatgatgagttcatgtcctttgtagggacatggatgaaattggaaatcatcattctcagtaaactatcaccagaacaaaaaaccaaacaccgcatattctcactcataggtgggaattgaacaataagaacacatggacacaggaaggggaacgtcacactctggggactgttgtggggtggggggagaggggagggatagcattaggagatatacctaatgctaaatgatgagttagtgggtgcagcacaccagcatggcacatgtatacatatgtaactaatctgcacattgtgcacatgtaccctaaaacttaaagtaaaataataataaaattaaaaaaaaagaaagacagcaactaatgctactttttaaattttcagttatatgttcagtatatggtatctttggtgcctatgaattatataaaatcagatcaaatatgcatttttctgtgatgctcactttcattgtaatatataaacaagatcctttcttaaaaaaaaaaaagaaaattccgtgtgtatatgtaggcccacacaattcaaacctgtgttgttcaaggggcaactgtagttgcataaaatatctgcgagactatagtttttgctggtacaaaatctagaataatcgctcttttattcctatttctttgtacttctaaactaataaagtattaaatattatgatagaggtatctgggtaagaaccatgtggagattgaagatgaggtattgtttgggctgaatggtgtcctccagtatgtgatagtatttggtgatgagttttttcttttgttttttgttttttgttttttttgagacagagtgtcgctctgtcccccaggctggagtgcagtggtgcaattttggctcatcgaaagctccgcctccctggttcatgccattctcctgcctcagcctcgtcagtagctgggactacaggtgcctgccaccacgcctgactaattttttgtatttttagtagagatggggtttcaccatgttagccaggatggtcccgatctcctgacctcgtgatctggtgatgagtttttttttaaattgggtgattaggttaaaagaaaaccattagggtgttacctataaagtctgactggtatccttacggaagagaaaaatttgacacatgaagaaacatcaggatgtgcatgaatagagaaaacacaatgtgaggacacagtataaatgtggccatctgcaagccaaagggagagacctcagaagacaccaaacctcttgacactttcattttggacttcacagcccccagaactgtgagaaaattaatttctgttgttaaagcatccagtctctggaattttagctctagcaaactgacatgggtatcaacataaaagttcataataacataagggtatttgataaattaagaataaattcacctgggatacaaagtgcatgtcaaaaaaaagttaacacgtgcaatgccagccctcaaatacccctttttcattacaatagcaataagtgtgccctgaggacaaaaataacaggtgctctgtatttaaggtctctggtaaaagtaaagtatcctcacaaaacttgggtcgctaaccaaattccctagagcagtgattctagaacagcagttctcaaattagttgctgaaaagttctacaaatccagcaaatgctgtcagaggtcttcaatatcctcccttttcaactttatatacttaaatccaaataacatgttacaataaattgaatgtgcaactaggagagataaattagttatctttctattaaggtgaacattgaagagattttcaaagatataatgcaccacagtatttctcattaattttttagaaatttaataattgtatttattttaaaaataaatatacaccttaaggttaatatgatttgtattattactattgaatgaattaataaatgaatattctaaacattctaagtgttaaaatctattacagtaaatcttgatatagtcaatataaacaaaaaatctttaaagcacctcaatttttaaaggagtaaggatcttgagatttaaaaaaacaactttagaactgatattcctgaagtttttatttttcatattgtatttcttcaccttaacataaatataaaagataacaagtgtcataattaaaatgtatgtttccctaaacccagttatctcaaaattatcaaaatatttctctaaaacacagttttctaaaaattgaggcatttatccttcacaagcataattaactcaattagagtcagcacattgatcaagcagcaaaattgttataattaagaaatgtaagtgtccaaattgaaaaaaaaaaaacactctaaaacatttctagcatctgcttttgagggacatcaggaattggcagaattggaggctctagccttcatgctcccagtattggcaaccatccacagacatgaatatctttatggaagccacagggtctagttgagaggttccagcacctccgtgggaccaaaaattcaagaatggattcactggagaagttaagaaaactagtttcacttaaccgttgtcacctctatcctaagatagcacagctcagtgctgagagaggttccctcagcccacaatttctcccacattaaaaaggaatcaaagtgaacacctggcttcccagccttgttggatgcttcttgggatgcccacttctcaatgtttcaggtaggtcttgtgggacgcaaaacgctaagaggaacagcatggctgaatcatctggggacaactaagagcagtgagaaggggaaagaatgcacagcaactgccacacggttctcaatctgtgccaatcctaccaacgggcttgtggagtccatcaagaggtccatctgtgaaccccacaggatgccctgcctgaagatcccttggccacagccagatgatctgccctgaacctctagtgggttgcaccatgggcatcccatgtgtgaaccatgtgagcttctgaagacaacacgtagatttcaacagcaggtgtatattgttgcaaccagctcaactttgctggtttggaagaaggctcacaaccttgaaaacttcagagcactgccataacgaaaataaacaagaagttatcagcactagtcttggctttgtgaggctgaatgaaggcacacaatcctgactttgcccctaaaagaggtcaaagaaaagtggggtgggtgcatcaatagtaaatgtatgagagacccaagaatgtctagctgggctcaccggtgaaggtcattctctcattaagccagttagtgaagacagaaatataagatgcctggatgactgatgtttcaaatgtaaagacagtaatgtaacaatttgtggaacacaaagaatcaatgagatatgacactactgaaggaacaaaataaaactataaaactccaaagaaatgagatatattaattgacaaataattcaaaataataatcttaaactcagtgaaccaggaaagaactcagactattaaatatattcaggaaaacacatactgaatgggaaaattcacaaaatgagaaattcatcaaagagatataaatcattaaaagaaccaaacagaaattctaggtttgaaaaatacaatgtctgacctgaaacatgaaaaagatcttcaaaacagactcaaggaagctgaagaaaaaaatcaaactttaatacagatcttttgaaatgatttagttagaagaaagcaaaggaaaaaagacagataaaaaagaaagcctactgggattatggagcaaaataaagtgaaccaatatacatattatatgagtcttggtaggagaagagaaaaagatgtggaaagcttatctaaataaataatgaccaaaatctgaaatctagagagggaaatgaacatttagatatatagcctaaggaagtccagatagattgagcataaagaggtcttcaccaagacacataagcaatatgtctaagtcaaacacaaagatagtttttaaaacatcaaaagaaaagtgaatcatcatatgcaagaaaaccttcactatcagtaggtttcccagtagaaaccatgcatgccaggagtcagtgggatgacaaattcaatcagctgaaaggagaaaaaaaaagacaaaacagcaaccaagaatactatacctggcaaagttgtctttaaaaaatgaagatgagattaaaaaaactttccaaaataaatgaaagctggggaagttcattaccactacacctgctttacaaaaaaaaatgctaaatggagttctttaagttgaaataaaagaatgcccattagcaatatgaaaatgtaaagtataaaactcacgggtaaaggtaagtatatagtcaaattcagaatgctctaattgtgcaatggtggtacatactttcaattctagtatataaattataagacaaaagtataaaaaatatgacaacaataaattgttaatggatacacaacacaaaaagatgtcaactgtgatactgataatgaataatgaggtagaaaaacatgtaagtgtgaagttttgtatccaattaagttaccagcttaaaatggtattataagattttagtgtaaggtgcatggtaattataaataaaaaatctttggcagatacacaaaagatgaagaaaaattaaagcataccacaaccaaaaaaattatcaaatcacaaaggaagctagcaagaggggaagaaaagaacaaaataactacaaaagcatgagaaacaattaataaaatggcaatagtaactctactatcaataactttattataaatagactacattgtctaataaaaatatatagaataactgaatagattaaatataagatccatatgctacatatgtgactcactttagatttaagaatatacataggctgaaagtgatggggtgcaaaaagatactccattgaaatggtatccaaaagcaaaaatgagtagttatacttttctgacaaaaaaatttaaatcaaaagctgttacaagagacaaagtcattatgttatgacagaaagatcaatttatcaagaggatataacaattgtaaacatatgtgcacccaaccatagagcaccttattataaaaagaaaatagtgacagaactgaagggagaaatcaagagcagtacaatgatagtagaggatgacaataacttacaataccttactttcagcaatatattattcagacagaaattcaatcaggaaatagtgaacttgaacaacaatatagaccaaatgtacctactagacaaatttgaaatattctatttaacatcagtagagtatacattgttttcaagtgtacatgaaaattctccagaacagatcatatgttaggccagaaaacaagtcttaacacatttaagtatcttgaaatcataaaaagttattttttaactaccaaggtatgaaactggaaatcaataacaggaggaaacaggaaaatttacaattatgtggtaatcaagcaattcactcctaaacaattggtcaaagaaaaataaaaatataaattaaaaatatattggaacaaactaaatagaaaatacaatatattaaaatttatgagatgcagcaagagcagttctaggagggaaatttataaatacctacattaagacaaaaaagatcttaaatttactcttcaaagaactaaaaaaaaagaatatcagatggaagaaaatagtaaacgttagagcagaaatcaatcaaatagacactagaaacaaaatggaaataaataaactgagttgtttttttaaaaaagataaaattgacaaaattttagttagataaacttagaaaaagagaagactcaaataaaattataaatgaaataagagacattacaactgatacttcaccaactcaaaggatcataagagaaaaattttatgccaataaattggataacctaaaagaaatgagtaagttgctatagacataccacctatcaagactgaaccatgaagtaatactaaatctaaacagattattaatgagtgatgagattgactcagtaatcaaaaatattccagtaacaacagcaataacaacaacaaactaagatatgatgtcttcacagctgaattttaccaaacatttaaagaagaactaataccaattcttctcaaactcttccaaaaattttaagcaggaggaatgttttcaagcttattctataggtcagcattaccttaataccaaagccaaacaaggacattacaaaataaataaataaatgaaaaattacaggccattatccttgatgaacatagattttaaaaatcctcaaaaaatactaaaaatcaaatataatagaacactaaaaaggtcacacaccatgatcaaataaaatttatctctgagatgcaagaatggttcaacatatgcaaatcaatgaattcgacataccacattaacagaatgaaggataaaatcatttgatcgtctcaatagatacagaaaaagcatctgacagaatttgaaactgtttaatgattaaaaactctcaataaataatgtactgaaagaatgtacatcagcatgttgttgtaaaggtcttatatgataagcccacagctaacatcatactcaatgatgaaaggctgagaactttttatctaatattaggaacgagacaaggatgaccactctcactacctctactcaacatagtattaaaagtcctaactagagcaagtaggaaagaaactgaaataaagatatataggtcataaaggaaaagttaaaattgtccttgttagaagatgatgtaatcttatgcatttagaataagatgccaccaaaaatctattagaatagatattaaaaaattcagtaaagaaataagtcaataaaattgtggtatacaaaagcaatatgaaaaaattagttacatttctacacacttaaaggacctttttgaaaaagaaaaaagcaatttcatttaaaataacacctaaaaggataaaatacagtagcacctaaaagaagaaaataaaatgaatttaaacaaggaggtgaaagatctatacatctatacattgatgaaactaattaaagtaactttctaaataaatagaaaaatacccagatattaataggttaaaaaactaatattgttagcatgttcacactagtcaaagggaactacagatgcaatataatccctataaaattctaatgacattattttacagaaatagaaaaaataaaataaaattcatgtggaaccacgtaagactctgtctgaattttcaaagcaatcttcagaaggagcaaaactagatgaattacacaaactgacttcaaaatatattacaaagctatgctaattcaaacagtattgtactggcattaaaataggaacttagagcaatgaaacagaagagggaacccacacactatctagtgaactctgtctatcctcaacaagagtgccaagaattcacaatggggaaaggattgcctgttcaataagcggtgttgaataaactagatatcaacatgcaaaagaaggaaatcggatccttattttacacaatacacaaaaatcaatgcaaaatggattgaagattcaaatgtcaacctaaaaccttaaaactcatagaaaaatatataaagggaaaagctccttggtattggccttgcaattttttttaatatgacaccaaaagcacaggcaacaaaagcaaaaataaacaagtcggacttatatcacactagaaagcttttgcacagcaaagaaaacaacagattgaagagaaaacctattgaatgagagaatacattgtggatattaatactggtaagggattactatgcaaaatatacaaggaactcatgcaaccaaatagaaaataacccaatttaaaaatgaacaaaaacagaatagtcagtaaatttttttcaaaaaagacatacaaatggccagcaagtacataaaaagatgcttaacaactgtgcattagagaatggaaaatcaaacccacgataagatattgccttataccagttaggtggctattatcaaaaaacacaacagatgagtgtcagtgcgggttaaagaaaaggaaacccttgtacaccattggtgggaatgtaaaatggtatggtcattatggaaaacagtatagaggatcctcaaaaaatcaaaaaatagaactatgatataactcagcaatctcatgtctgattatccaaaggataatcaggagctcaaggagatatctgcactcccattgcaacaatcttcaatagacaacatacggaaacaatttaactgtccatcaatgaatgaatgggtaagaaaacatgaaacacacacacacacacacacacacacacgaatggaatattagccttaaaacggaaagaagttctgccatttgcaacaacatggatggacctgaaggacataatattaaatgaaataatccagacacagaaagacaaatacttacatgtggaaactaaaatagtcaactcacggaagcagagagtaaattgtggttgctgggggctgacagagaaggaattgggaggtgatggttaaacgttttagtcaggcaagagaaataagttctgaggatcttctataaagatcttctataaagcatagtgccagaagtaacaatactgtattgcatactcaaaatttgctaagaggatagatcttatgttaagcgttttaacaacaacaaaaccctaataataataataatgataataataataaaataggtgagagaatattgtggaaggagatggacatgtttatggccttgatagtggtgatggtttcacacatgtaaacttaacccagactcattaacatgtagctatgaaatatacacaccttttttatatgtcaatcatatctcaaatggcaaataaataaatttttcaatctacaaacctggaataaaattttggctactaattctctcacaattattcaacaaatcacattcactaatatcaacacacaacccaaattaaaacagtttattatcttcactactaccaccagtttatgctatcattttttttcacgaagcctactaagacagcctcatttctcttctcctttcccctgctaacacctcacctcacattacattctctcccaatacaaaagagtaacttttctaaaacagaaatgaaattattccttggtttattcaaaaccataataatttctcattatgtacagaatttaaaaaataattcatctcatgatatgtaagatcttaatgaatcggctcctcctttggtagattggttgcccaaatattttcagcactttagctcttcctttgcaatagattttgcaaatcttcccaataataaaatatggagtctgtttctttaccccataaaaactgggttgaacttatgacctgcttccctcaatataaggcaggcagcagaatggactctcagtttcacacctagaatacgagaagtcttgcatgttttactgtcttttggacccttacctctgttacaagtacagacctgagctatgtactgcaggatgagaaaccacatggcatagaagagccatcccattggaggccatcctaaactgtcccctagctgagttaccaccacgtgacagtagatgtgtaatcaagcccagcagagatggattgaattaggcccaaagacccacataaaataataaatggtggttttttaggcaactaaaattttagagtaacttgtacaaggtatcaggcatgaaacaatacctgatatctgtgtattttgccatgaacatttccatcaatcccaatttatgtcctcttatttagtcttagtggccttccttgaagtcatgcttatgcttatttcaggaatttgtacctgttctttcctctgtctgcagtacacttacatgagatttttccatggacttttctcactttattctgcattctgttcatacataaccatcccccttccctaggaatgccttcataatcattatactttcccctcagcatgctgttttattccatagccattatgtctacccaatatacatggtataattatttttttcattttcttcacatatccttagtaaatatatcaaagaaactgcacataaagaaatgatatatttagatatttaacagctatatattgaatatacagtatcattttcttgaaaaaaaactcatgttcttctgaaatatttctatataaaattagctcaaataagaactacggagaaaatttagctggcaccaaagactgctatgacagattgcataaatgtattgttatcttctgtctttttatttttattttttttttatttattatttctttttaaagacagagtctcactttgttgtccaggcagcagtgcagtggcatgatctcgggtcactgcaacttcaacctcccaggttcaagcgattctcctgcctcgcctcctaagtagctgggattacgggcaggtgccaccacacctggctaatttttgtatttttagtagagacagggtttctccatgttggctaggctggccttgaactcctgacctcaggggatttgcctgcctcagcctcccaaagtgctgggattacaggtgtaagccactgtgcccggctgttatcctctgtcttagctcacttcctgttgcttacaacagaatacctgaaaccaagtaacttataaggatagaaaatttatttttttctcttctggaggctgggaagttcaaagtcaaggggctgaatctgatgagtgttttcttgctggtgggcactctttccagaatcctgaggtggtgcagagcatcacatgagggggctgagtgtgctcatgtatcaatgtgctctcttccttttcttataaagccaccagtttccgccccatgacagtccattaatccactaactgattaatccataaatgggttaatctattcacaagggcagaagcctcatcatccaattatctcttagcggacctacctctccatactgccacattggaaattgtttaaacatgaattttagaggggacatttcactgttttaaaggaataatgcaaagacccttcaaatttgttgatgtcagtgtttatgaataatgagaggaaaaatcacatttcagaaaataatttgaacgagtacataacaaaattttatggttattttaaaacatactgttttaatgcaacttacaacttaaaactactgatgccacgtaggtaacttctccattattaataaaaatgatgaacaacatgccatagttattcaatcaacaattcccagagatcaccttgaatgtaaggtctgaaatagacctgggattgccttacttggatattaagctttatggagcagcaactcttcatttgcttctactttatatgaaaaggacagtgctacagacatagagcagtacattttcagcaagccaccccaggaatgtgcaccgatagcctcattaaggcttgtagaagctgtgctacattatttctcaacacatcactcaatgtctccacattatttaattctttcaatgccatgtttatgacatgactcaggatatagagtatgggcactactaaaaagaaatgtggagtttgtgtcttagcaacgtttaattctagggtttttttttttccttttgaaagtatacagatgcatcagaaagattagcataagttttgccccatattaaagattaaggagacaggaatatagttgttttcatttcactgtgaagaaaaagaaggaaataattttaaagcaaacacatggatttagttaccttctgttctaagcccaatgccaataccaaatataacaagcagtaaagacgaatttggcaattcccacagccctttatacagtgtactcttctagtgtttgaagcacccagcatgttgcaataatcacaacatatatgttcaaaaaatcttaacagaatgagctttgattcaagtgtttcacagtaaaatatataatgaaatattcttggtaaaataaataaaaaatattaagtatttaaataatgtggtgaacagttttttcatgttactttaataatgctagaagtatggaaattttggaaatccagtgttttattaccattagcttttgatttttctagctgattttttttagctattatactgtttttcaaattagatcagaaactttttctggtttgttctcacttcctaaaagcaaatattacaatgaaatatttagcatcaatttaatggtggattaaagatagctgcagtttcctggacacgcttccttttaagatacagatctattctacctttgttccaaccagaactgacctgtgactgttggacaaatgtcacacactgtagaaataatactatggtcagttctgctacccttatttaagagaactgggagtttctgtcttgctctctaagggtgccaagccaccatgtaagacgtctaatcatcctgctaaagaatgcatctgaataccggaagacagagaggagcccagatgaatacagcctttcaactgcccctcacagggcaggcatgtgggaaacgtcccgggtcctgcagacctgtcttcagctaaatgcccagtgactcagtcaacatcacatgaagcagaagattcagccaactgaacccaatgggaatttctgacccaggaaattataaaatacaataaatggttgttattctaatatattaaactttcagtggtttattatgaagttttgagtaataagaacaatatccctttagtctaccccagggtttggcaaactctttctgtaaatggcataagagtgaatattgtagacattgcaggccatattgtctcgttgcaactactcaactcagccatggtagcacaaaagcaaccatagcaacatgtgaatacttgtgtgtggcttgctttaataacacttcatttataaaaacaggtgataaacagatttggcccttgccatacttaaccaacctctggtctacacaaaactgttgtctaaacctaagttccgaatgccttcaatgagaacactaaatccaagtaaaattagatactcaggaaattaacaacaatagtaattccaatttcaacatgaggcagtgaattcacatagagttatataagttagtgataattttgtttctgtaaataatttttactgtttttttaaatattagagtttaagtgacatcatggtgagatgtacagggtatatttgaattgttctaagctgggtacaaataccagaagcgccatacctatactagctttatttttaactgtatattacagatgttaactgcaaagggttaaaaggcctacactaacaagggtaagccccagcctaatttttcatgctcagtcctcaaatttccagtgtaatcacgttgacattcttaaacttcccattcctttgttaagtttagagccccagaatgcactttcgccagacttgcttctgcttctgaaaactgatcgctgaaattttgccttaaaccacgcatcattgtcctgtttctttgtttttcgatttttttctcttgatcggcctgagtacttgtaatgcataaaacctctcctaactgccagaaggcagaatgtctcatcttcagactgaaactcttgcaaacagggagaaaagcctttctttttcttgctccactctggtggtttctacttcaggatcttttgacataactaatttctcagtattgtttcctcttcttttaaatgcaagtaagaacagacaaatttataagatatttaggatggttagattttacaattgattttaagtacttaacagtttgtgtgaatccaatagattcccattctctttactgcttttactcagctgtaatatattgttcttacataaatattaaatatggactgaactacaaggaaattcatctggatcaaattgttggttttgattttgtgtatttgtgtttactacacacatttttttaaagttttcaatttatttatttataatatacacagaaatactatttgggggatacagctctatgagttttgagaaatttatagagttatgaagccactaccaaaaccaaagtataaagcagtatcctcaccctagaaattccagcctccccaacactagctcctggcaacttttgacatactttttatatctacaactttaaaaattcttttacagaatatcatataaagtggatcatggcaaatatagcctttaaaaaaatctttttcttattttaatagacaataattatattatatgtgaatggggtacaatgagatatcattatatatgtatatatagtgaaatgattaaatcaagctaattattacatatattatctcatacttatatatttgtggtgagaacatttaaaaatcttcttttttagtgattttaaaatagactttattattgattatagtcatcatgctgtgaaataggtcactaaaatttttatttctcttgtttttttttttttttttttttttttgagacacactctcgctctgtcacccaggctggagtgcagtggtgcgacctcggctcactgcagcctctgccttctgggttgaagtgattctcttgcctcagcctcccaagtactacaggcacgtgccaccatgcctggctaatttttgtatttttagtatagacagggtttcaccatattggccaggctggtctcaaacccctgacctcgtgatccgccagcctcggcctcccaaagtgctgggattacaggtgtgagccaccacacccgacctattcttcttgtttaatcaaaactttgcacccttggactaatatctccccttccctgtccactgtcccacctctgggaaccaccattctactctgtatttccgtgagttgctatatacaaccttctgaattttgctgttactgttttcacttagcataacatttgagatctgtcatgttatttcagtggttctttcctctgtggtactgaataatgctccattgtatgaaagtaccacacttgattcaccagttgaagaagactcggttcctagttattacaaaattacgcataaagcttctgtaatcagcattcctgtggtggattatggtggattatgtcctcctctctcaattcatatgctgaagccttcacccctaacgtgactatgttcagagttggaagcttttaagagataaggctgaaccaggttatataggtggttacaggttatttgattattttactagtgctcttgtaaggagaggaaaagacacttgatctctctctgtctctctctctctctctttctgtctctcacatgcactctctcagcaagaggagaggccatctagccaggaagagaggactcactaaaaaaaatcaaccctgacagcacctcgatattgcacttctagcctccagaactgtaaaaaaaaaaaaaattaataataaatatactgctgtttgagctatccagtctgtggtactttgttatggcagcctgagaagacgaatacaattcttttctcagttattttgtgttgctctaaaggaataatggaggctaggtactttatttatttttaaaaaggtttatttggcttacaattctgacggctaaaaagttcaagattggacttctgcatctggtgagggcctcaggctgcttccactcgaggctgcggaaggcgaaagggagcgcggtggcgtgtgcagatctcatggtgacagaggaagcaagacagagagcgggaagtaccaggtcctttaaaacagccagctctcaggaaactaacagaatgagagctgattcatccccaaggaagggcagtaaactattcaagaggaagccacccccacaacccaaacacctcccattagtccccattttcaatagtagggatcaaatttcaatatgaggtttggaggagacaaacatgcaaaccatagcaattgctatgtaaatattgtgtgaacatgggtatttttctcctgtataaatatctgtgagtgggaatattgaatggtttctaatgtttcataagcaattgccaaactattttccagtctgtatcactttttattcccatcaacaatatatagacctctaggtgctccacatcttgggggttacttgttatagcaatctatctgtctatctatctatctgtctatctatctatctgtctatctatctacctatcatctatctttctgctttcatctatctgtctataattatcttcatctatccattacaatttatcattctaataaatgtacagtggtatttcttggttttagctttcatttttcttatttctaatgactagtaatgttgaccatttttcatgtattatttgccatttgtatattgattttggtattcaaatattttgttcattttgtattaggaagttttcttttaacttttgctttaaaaacacatattctgaatacaagctttttatttttttggccttatgtgggttttgcaaatgtgttcttccagtaaagtttgccttttcattgtctttaaccgtttttttctagaactaaacattttaatgtcaatgaggtacatatgtacactatataaatgctgttgctattgtatctataaaatctgcaaactggagggtgcattttcttctatattttcttttagaagttgtataatatgaggtcttacattgttctataatcacctttgagtttatttttatatacagttcaaggtaggaattgagattcacttaaatatgtttgcatatgaatgtaaacagctccagcaacatttggtgaaaaatctatcatttctccttgtaaatgagtttgcaccttggtaaaaaattacttgatatatctacggatctatttctgcattctctatccagttccattggtgtatctgcttattctttcttcaatatcacattgtcttgcttcctgtagcttccaagtaagtcttgcaatcaggtagcttgagtcttcagctgtgtgtgtgtgtgtgtgtgtgtgtgtgttgtgtgtgtgtgtgttttccagatcattttggccatttctgttcatcgactttctatataaattttaaaaatcatcttgtaaatttctacaaaaaaagcttcagaaaaaaatgattgagatggcttttaacaatatattactatgtgaagaattgccactgatacctagttatccaagcaaagaacatagtatatctctctgtttgtttttgtcttttaaaatttcttctattgatgatttctagttttaggatatagaccctgaacatattttgttaggtttatacttaatatttcatattgacagagctacctaaataatatttatttcttcttcctatatactagcaatgaaaccctatgggcctgaagattgcttttgagggaatatttaagttataaatttattttccttaatagatatagggctactcaaataatctatttcattttgggtgagttgtggtttgtgttttggaagaatttgcccacacttttcaagttgtccaattgatgtgtgtatagttgtattgctattcccttattatttttgggatgtcttcagggtctgtagtaatagcctattactgattattttaatttgtgtcatgtctctcttttctattcatgctagaggtatgttccacaaattttgatatttaatattcatacatctacttagttaaatataattttgtatattgaccttgagactttctttttgagccatggtttctttagaagtgtgttattttatttctaagcacttggaaattttcccactttattttgattattaatttatactttgattccattgtgatccaagaacacattccgtgtggtttcggttattttaaattaaattagtttgtttcacagagatagatatgttctatcttgctatattgtccatggccatttgaaaagagtaagtattttgagtgaaacattttaagacgttgatttggtcctgtagatggatggtattgttggattgttctatattctttctaatttcctgtctagttcagttaattgttaagaaaaagaagtttcagtctccaacaataattattcatttgtctatttctcctttcagttctgtcagttttctcttgtaaattttatagctctgttatttgatttatacacatttaagatttctatgtctatgtggtggatttatatttttattatacaatgtccatttctatcactggtaattttctttcccttgaagcctactttctctgacgttaatacaggcactcctctttgctgttgattcaggcttgaatgatatatcattctcatttttttactatccacctgcttgtggacagtgtttgttggaaaatatattttaatcaacttcatgtatctcttcattttaattggtatattttgactatataatgcaattacagatatttactattaaagtctacaatttattattatttttgttctgtttgttttttgtttctgttttttttttctcctgctttcctgtgggttaagtgaacaatttttagaattcaatttagattgcctatactgtttgttatatacactttgtatatcctgtcttagtggttcttttaggtattatattctatatacataacatgaccagtgaccgatgtcatcattttaccaacttaagtgggatgtagaaaacttacctttctttatgttctgatactttcctcttttacaatcattttaaacatttcttctacataacattttaaaatgaattagtgttaaaaattggttcaaccactaaatttaaattagaaaacttgagagaaggaaagaatatcatatatacccataattctgcttattatattcttttttcttcctcatagtcaaagatttctctttttataatttctcctctgtttagtgaatttccattagccattctttttaaaaaaatatcagtctactggtgataaattctcttagttttcctttatattataatgctgaaaaatattccttttatttatgaaaaatattcatgctggatagaggattctgctttaacagttactttctgtttacacatgaaaaacgtgccactttctcctgagctccaagtcttctaatcaaaattcactgtcatataaattatctttcttgtagtgatttgtcattttattctctttgcttttaagatttttcttttcagaaacttgacaacaatatatattgtgataagtgtgtgtgctttgtgtgtgtgttgggagtggtttatgatggaagtcactctgtgtctttaatctgtaggtttatgttttttcaaacatttgttgagccattattttttcaagcacttattaacttacccactttgtcctccccttccaggacttcatatcacacaaatattagatcttttgttgtagatgcacagtaatctgaagctctatttttttttaattttttggtctattttctttctgttgctcagattggataattactatagttctatcttctggtccactgaatattcactctgtttcctctatttttctgttaagctcacccattatttttcagttctaagatttccattgaaatctgttttatatcttctaaatctttgttgacactttctattgctttgttggtgcatgctatttttgtttaaattcttttgttttaattactagttgaagctctttctgtcagataattctagccttccattacctcaatgttggcatttattaattgcctttttcagtcagttggaaatcttctttgttcttgaagtgagtgatcttcaatcaaaacttgtctggatcttatttaaaccctttgttttagttgagtgcctctgacttcactttagcagaagaaaggagatgtctgcaaggttctctgctcagcctccattgacaacaggatgggacagagtctccctgttagtgctgggtgggagtgggggttctgcctccccctgggcttccacagatacatttctgaacgtaaaaaatctctctgcctccttttctcttcttataagggcacttgtcattggattcagggcccgctgtagtcaagtatgaactcatttcactatcactaattacaactgtaagggctctatctccaaatcatatcacaatctgagatgccggtgttccatgaatttgaatagaacactattcaacccactacaccttctcaagctcctcttctttaacaacacctcaacctttccatttctaggaaggagagaaaaagagaaagagacatacacagagggacagagtggagagtctctattggtcatgctcattaagcatcctgatattaagcctgtgctatggtttgaatgtatctttcaaagttcatgtgttggaaacaatccccaatgcaacagtgttgaaaggtggaacctttaagaggtgcttatgttgtgagggctctgccctcatgaatggattaatgccatgatctgaagtagggtggttatcttgagagtaggttcctgataaaaggaagagttcacccaccttcacttctcttgcaagtattctcacttaccctttgccttgccccaaggtataacacaacaagaaggcctttgcaggatgtgggaaccttgcccttggacttcccagcctccagaactataagatataaatctctgctttttataaattacctagtctcaggtattctgtcacggccacacaaagtgaattaagatataccaccctgacacttagtcagaagataggaaagggaaacggactagaaaattcactgctgtgttgttgttcttttagattctattaccctcctcggcctgcctggaattatttattttaagagtcatcaggttttacattttctgttcagggattttagttataattaatgggagacatagcatggtatgtattgatttcatcttagctagaaccagaaatcttcagtccaattatatttaatgtaaatatccatctggctatgtttaggtctaccatattttaatttttttctttgtcctttttaacttttattcttctattctctctttcctgcattctttatatttacttggatatttttgtgttctatttttatttatgaattaactttttaaagtgacatatctttatattattttcatggttcctctacagaatataatgcctaaattttcacattctagttggttgccatagtggtcataaatacatgtatatattatttattatacatatatatatccaatatattacttatatgtatctaccagaaaatactgtcataatataaatttttgctttcaacaattatctttcaaataatttatccagacagctgccatttttgttactattctttcaattctgaagatccaaatttctttcttcctttagtctaaagatatttctttagcattcctttagggtaggacttctgacaacatatttttccagtcttcttttatttataatgttttgatattgtctttatttctgaaatttaattttgctgaatacagagatttaggttgacagctctcttccttcagcactttcaagatgctcttctactatattctggcctttgtagtttctggtaagacctgctatttatgtagtttttctcatatatataaaatactatttttccctacctaccttcacgttttctcccccctttgacttttagaaatgtggctatgatgggtcttggttggcttccttaagttcatcttgtttgaggtttcacaagatttttgaacccgtaaatttatatttttcttctcaaattttgaaaactctattattttgtcaaatatttttattttcctatttctattgtctatccttctagtgctttgatggaatatatattatatctcttgatattaggccaggagctctgtttatttttgttttaaatttttttttctctctgaccttcaggatttataaatgttattgatttatcttcagattcacttaaccatcttctgtcatcttcattgtgctattaagcccatataatgattttattttacaactattccttttccttgtcctaaaatgttcttttgattcttttttatttcaatgctaagaacttctgtctttccatttatatttaagtatgtttatctttttcttatggaggacaattatactagatgattaaaagtctttatttgatcatttcaatgtccaggtcatttctacattagtatttgttgattttcactttgcttgagaattggccatattttcctggttccttgtgaacttagtaattttggattatatcagtgacattttgaatgttatgtttagattatgaatactgttataatctagagagtgtttattttctttagttttgcagaaaatcaaactcactggtttcaggccatgaggctagtttgccttctttaaatgctagtttcaatcccagcttttcagggtctttgctatgttgcagcacgtccatcccacatatgtagatgtcataaatgagccccagattagtttccactcatgcacaaaattgagaactcttcttttcttgttgtctcccctctaagatattctgtgacactctctggcccacacagttttctttatccagttccattagattttatttttctacttctcttgagtgcacttgtaccactggaacctgcctttggggcacaccataagaacaatgagtataaaataataaaaataaagaggaaacacattcctttacaggttacttcctctgattttgacttccttctgtgatctacttgttcttacttattttttaaactcttcagataattgctttttttgtactttatttagttcttcattgtaatcagtaggaaagataacccatagtgaatatatcctaccatgctggaagaattgaaaaaccttggtattttcaattcctgatgagtcagatggttctgaagattttatttgttccattaaagactttttttttttcccacaaaatagcatcacacttgatgggaaaatggctgaaaaactaggaaactgaacataattaatataattaataaatgctaacaaagtttctattctaaaggaaaaagtttctaggtctattggaatgaaaatttagctttaatcaccaatacttcattttctgaaaattcatcttaatatcaaaataaaaagaccatactatttttagagaaatatatctcatcctatttgatcatcataattatgaaaatctcaataatatgaatgaaaatccataaaaaccagagtaagaaagatattaagcaaaaccataaatatagttctacatcatattttttcattttctaacattggagatatacacacaactcattactattctgagacttttgttagcaaggattaacattgtccttctttagattccacatgcacataaatattaaatatatattctcatccatttttttcttgtaatccaaacagaaagctgtagaatgtagtaagggattattacaaaaactgagcatatcctccaaacagattaaaggaacatatctattattaatcctgatgtttccaagcatattaaatattgtttaacctgctacaaataattgaacttgtataaccactgtatgtgccaatattaagaattaggcatactcttgattaatgtagtagatggtttcaggcctcaaggccttaaagcagtgctgtaaatctgcttatatattaaaagagcccttgaagctttaactttatattatccttctagttggttgcttagtacaaactacataaacttaagtagctgtcaatatctacgatgaagttaatcattgtgttgttaaaagggttttgttaaaaggaaaaattcatcatttgtatttaataattggtcaaattgtattgaagttaaaaagtttttcatttgtttatatctacaggaaatatgaatttggcaattaccattaacatttaaaattgtaaagtgaaaaaaatatagttcctagacttcaagaaatctaattaagatggaaagccatatactgaagaaatatcacattactaacccaggcaggatatgttaaatcaccttggacgactaaaattctgctgcttttctcatctatgaaatgagtttgacactacatttttaaagtttcaaaaacagttgccaaattagtgctctatacataagtagtgtacaccaataaaggatggaagatgaatgattgttagtcccatgtctataaatgcttatcaatttctagttaatagtgagttattaacattcaaccaagtaaagagattatcccaccctaaaaaaaatttgaaagtataattatatgatttattaataatatagtgatacaatataatttgatataataaactaaataaaattagagatttgatatcacactaccctatactggctaaaacacacctgagtattatagtatctatattttattaaataaaaaacaacatctttaatggtaaagccactcaaagtatttcaaattaaaaatgagccaaagaagtttttatgaatggacacaaattagttcttcaattagccaaaggctgtctttaaggagtttgaacaaaggcattctgcaaaatcataaagaatattaacaatgaatgaataaaaagagatatatatctttttttacaatcgggtataccatggaattgtcctatcagatgttactctttaaaatgttcttatgatcaagtaattttagaaaacatggaatatcaaatattctaaaaaatttacagcacacttgtaaatttcaagattattttgttgagccttcattatgtaggcatgagtgactgaatcatgagtcacttggttgaacacaatctgcagtccggcctcctctcttctgcagaggccaggcggatatcacttagctccaatgtcctgaccttctaaccacatgttctttctgccatggccaaccccagcctccatcatttatttaccgtaaatcatggatcacctcattagcataacggcctaggaagtataacaaaaacactccaatcgcttgataaattctagcagtttagaggttacctcccaggaacctgggatatatgccagccaaattcattattacacaaaggtgcacctcagaataatcaagaaagcatcccatgaaagagcctgtactcagacatctgccccagaaaaggggggtttcaacatcagactgtaatggcaacattcaagtaataaattctaatgctcttcccctaaattttgctgctctgaccctggatagaggaagtggggttgagatggagcaagaaagacagaggaaattacagcttctttatccactgctggtttctccgagcattgacttgccagggagctgtgagggagaggaacttttttaatggaatgatgatttatattttatttacattgagataggttgttaatttctgaaaatgagattgagagtaacttggaagttttgccttctgccccatattttctccagtgccagagacaagaaatccaatacggtaggcttagaaaagcatggtgggaggaaaaacaaattgattttgccctttctggttcagctagttcaataatctatttgtgagtgcatttcaatcccttaggaaattgtaatttaactctcactgtccgtggtcaaacatgctttaccacaggtcttccactaacattgttttgttcaacgttgttttgtcataatgttgataagaaaataaaaaaaataataataataaaaaaatggctttctagccagagccactgtctgtgtggacgctgcattttctccttacatcctcatgggttttctcctaggattctggtttcctgccacatcccaaagctgtgtatgtttggttcactggtgtgtgtacattgtcccagtgtgagtgagtgtgggtgactgtgaatcaccctgctgtgggatgataccctggactgaaataagcaggtaaataattatcttacttgttttgattaatcccttttaaatgtatgtatatagcacacatgtatttcaatgtttcatattagaagtattttggtgtttgtttgtttgtttagaagtttggtaatgtttttgtgaccaggaactttagtccatatcaattaacctatgggaaaattggtttctttatagtcattttgcttgaagtctcagtttccaagaactgaccggcaatgttgagtgagcacttactgcacaggcacttggtggggatggttgtaaggaaataaagataggctcaatttgtcctagactttactgtcccctccagtcctgggtttctctcatcaggttcacataggagagcatcactgtcatctggagtttagagggttttgtcctgaactgcccactgaggttgctccaaaagtggtagcaaggttcccacaaggaagtgccccaaaccttcctgggaggaggctggctgggattccagagaaagaagcactaaacgagagggagatcagtccaaagcccttgtagaggccctttgtacagagtgctgcagcaatcctggagatggacagagagaacaaagggatgttctagctaggaatgcctgcagccagaaggccaggatgtggagtttacatcagggtttaatgcatttggctcagggctgggccagtttctttcagtgttttggacaacaacctagatggctttatcggtgcctgggaatattcagggcctagtatgggatccagcctgctaggaaaacatcagcttgctgtgccactctgtgatttttttaaagcactgtacgattttttttttttttatctcaggacacagaaggaaagtgaccttacaggggagagattcacagaattagttacaactttcctttatcacttaacattggagttcatactgctatattgatattctattgaaactaaatattgaagtcacatggtcatgatgaatagcaaacatttatatatcacctactatgtcagaatatttcaaatatttttctattttaacttatttaattctctccataagcctaaagttgggttcttttactaccagcattttacggataagaaaactaagacacagaaaggttaagtaaaattcctaatgttaaacagccggttagtcttcgactcaagtatttatccaagtatactatctctaaattccacataatccactactatcgaactgcctctaatgtaatcaaaatcatattatgagtgcaaggcatctaaaaactagtctgtttcagcagggcgtggtggctcacacctgtaatcccaggactttgggagactcaggtgggcagatcaattgaggtcaggagtacaagaccagcctggccaacatggtgaaaccccatctctactaaaaatacaaaaattagccaggtgtggtggcaggtgcctgtagtcccagctcctcgggaggccgaagcaggagaattgcttgaatctgttaggcggaggttgcagtgagccgagatcttgccactgccctccatactgggcgacacagtgagactctgtctcaaaaacaaacaaacaaacaaacaaacagaccagtctatttcaagttccttaccatacggttgaggtacaaaattaaatagcaagctaatgaagataggtacagtgtagcaataccattattttttttaacaccaatcttctgactctttttacaatgtccttttgattgattattttagaaacttttatcttcctttgttttaattccagggaacctttctttaaattgaatctcctgtggaatctgctgcataaaactgaaaagtcccactgagctgaagtgggaattcagagctttgcttgctccccaccacctgttcttgtcttgtttgacatctctgtgctatttcatgcatctctttttagagttacatttcccttagcatctgtgacacaagacccctctaattctcatgctacttcataatgtcttattttttaaccttatttaacagggggtggggacagggaactgcaaatcttcatctgctcacagtttaaatgtaaatatatgacaaattttctggtgacagtactgtatagataaaaatttgagaaaagcaagtagtgttcaacaagagacttgaaagataagaagtaatttcacaatgagaaggaaatggataatggattacctcagaagaaggaggaaagtaccggttaattcaagttatgatattattgaattgaaaaagtgcaggcagaaaatgtatcttttgagttaaatagcatatacctttcttattagttaaaatagtcttcactgtctttaacctaaagagttacagtgttcccagtgggatttaaagttactttttaatgagataaggaatcatagaacctaattaacttatcattaagaaaactagagagatttaaaaatatacataattcttggggcagggagagaaaggagaaacaatatattataccattcactcttggagtaggtacagtgtgaaaactagaaatagaatagaacaacatttatacacagcccttttccagtatgactttcccttattgggcatatttgaagtgggtatcattcagaatgtaatcaatagattaaaatttgggagatgatggttaaagttattttttttccctttggatcccttcataggcagctggcacataggaatagttggtgactatgtcccaaaaagtctttattttattttgttatttattatttattgatttactcttcgagacagggtcttgttcgtttgcccaggctgcagtgcagtggcaagatcatggttcattccagcctcaaactccttggcccaaacactcttcctgcctcagcctcccaagtagctggtagtgcagacttgtgctacatcacccaagtttttattattattttttgtagagagagggtcttgctatttttcccaggcttgtcaaactcctgcccttaagggatcctcctgccttgccctcccgaagtgttgggaatataggcatgggccaccatgccctgccagtatattttatttgaatttggtaaaaccaatacaaacacataacgctaaaggaaagaatctcgctctgtcgcccaggctggagtgcagtggagcgatctcggctcactgcaagctctgcctcccgggttcacgccattctcttgcctcagcctcctgagtagctgggactacaggcacccgccaccacgcccagctaattttttgtatttttagtagagacagggtttcaccgtgttagccaggatgatttcggtctcctgaccttgtgatctgtctgccttggcctcccaaagtgatgggattagaggtgtgaaccacggcgcccggccggaaagattctttttaaacatcaagtaataactaatcagtgaactgccagttaatttgaactgattggtgatacaagcaacatgagacattaggactggcattcaaggatgaaaatagagctacaaataatcaaatattattatggatgcccaattattaagcaaacttaacatctcattgaatagattacacatctcctgagtagtttatattatatgggtgtaggagtattaaaatatagtcactagaccttcaataacagtgaagctcacttctatattacctaaaaatattattgtttacatggtataataatgctcctgggaagtcttctcagatatctgaatataaacaaagtctcttaatggaaggggctgtcaaaaattgtagtgtaattccatatgtgtggctttatgaacattcacatacaaaacaacacacacgtgtgtatgtgtcagacatatggtgttgtaatgcctttataagagggcttcactacataataacttactataaaacaaatgttgttatttaaattattaccagcagaaaattgcctgttgtactgtattttatagagaagacagctcataaatgcactaaagtgcaaagacatttttaaaaaggcaataatgaattttcaataatgaagcctagtaatagcagtgtaagaaagcatctgaaagctgataaaatctatattttagcactgtttctatatgtacaaggtaaggctttctgatctcaattgtcagtatgaattttttgtttcaatttataaagatcaaattcacatttttgaagtgagttattattgcatatcttcatttaaggtcaggcacaattttgaacatgttaatcaaaaagaatacttattgtcatatctcacttctgacatttaagaaaaactcttcatgcaaattaagtatgtgactacactaccaaaagagtgtatcaaatacttaacacagaaatacaatgaacttctctatattgactgaagtccttcatgtgcctcttctcaagtgcaaattagactcagatttctcctctttgaagtacagttacccttgtacatacactgcttaaagcgttacttatatctatcatgaatcaaaattaaagtatccctttaaaatatttccaggcacaagatttttatatcttataaaaaatacccaattcagaaggattgttggattcatcaagctatttttttgtaacttataattggctttttaaaaactgaaaatatcagtttattttctcctaagataatttccttcaaatactcaacttctttatcacatctgatttttaatgattacctattttcttctaatttccagagtctctctatttataatacaaattgtacttcatcacacaggaaccttaattggatataattgggatgaaagtgttctcactcatgctttacgagtctcaaaggcaaaaaaaaaaaatgtagcaaatcagcacaaaaacccacacccttctttccacggtggtggagaggaagctcacaggaagccctggcagtcagacttggcaactgctcactctcactggagctttcattgctagagtgagcactccatttccaagagtctttcatctatctgagcatccattgacaatcatgtacagcagaaaatagtaccttgtgtaatcaagggagttttccaaaacctggtaagtaaaaccaggatgccaggcaaggttagaatgccacagaataaataggggctgctttgttctggtttagtaaatttgtttagcttttcttatgtcccatttcaatgatgtgctgttgtttcaaaagggataggacaaggtatttgcccttggcttccaagggcaaaatctcttggattttactctacgtagaggatatgtctttgatcatgtcattttttttctgtctctcaaatttatatttaactatcctttaataaattagagagcatcatgcaatttcaacaacaaaaaattattgcttaattctatggggtcacattgtgaatttattatctaatttcggtataatattcatcttctattatggtccaataagcagaagaacaatgagacttcatctcttgttttaaatcctactttaattcttaccaagtggtttatttgatcataattattttggcatcagtgtaaacctggctattattgtttatccagcataagcccgtgagacacctgaaaacttcacatgacaaaatgatgcagaaaatttcattacatttctgtaaaaagtcatacacttagtgttgcaggtcaggttccctgggaaacagactggagctggcgatttgtgtgctagaagtttattaaggagtgctctcaggatcaactcctgagagaaagaaaagaaagcaggatttagtagggagaaattaggctgctgcatagtcaccacaaaggcctaagtctgtcctttaggtagttctagagctggtatggcctaccaaatttgccttatgaaaggtatggtatctggatctttatacctcatagcatccaaccatgtacacatgagatcacagataaggcaggagaagcaaatctcttcagcaaagggcaatcaatcgccaggagccacaacactgtggcaccacagttaacgctccaaggatccagagaaatgtgtgctttcactttgaaaggtggtgtggaatattggagttgtagcctgtggcatccattactcacatgttaatatatcttgattcagtactaacctttttttcttgaatttttggaattaagggcttggtacatatttgaccattggaaatccaaatacttcctgttttatatcacagaaatgttggtgccttcatagcaccaagacatgtaattcatcaaaatagtacatatagttcctttccttttttctgtatccttgattcttgtcccacatcttatgtgtacactttgttagaagcagatctttgagcagcaactaaagaagtgttcagctagtcctgtgtctgctgttataggaagaagtgtgtttcctcaaagttggagtagatgtagccaagtagatcgtgagtagctactgaagtgctagcagcagcagtatgatgcaaaaaagcacacgctggcacccctttttgataaactagcagatacaatgattttttctttccattataaatacaactatttgggcagatacagcagtaagccttgatcaattttcatggaaagataacagttatgaataatagtgtaaaacaaacagaacacaggcttatatcatttgcaaactcaataactgaattttgaaaagtttaaaattgactgtataatgaaatattgaaaaagagttgggaataagagagaagcactatgcattagacagttgtatcctctgaaatgttcctgcttattggatcatccttgggcacttttcctgagaaaggctcagacaaagctgtaaatagaggcagtttggggatcaatggccagaacctagggccttgaatattgagtcagaggtatggaatctatcacagtttcaatcaaaccacgaaatgtttggaaatggccaataaaagtccaaacaaaaaatcaatacatttctaacatctagaattgaataagtaacagaagatggtgatcaaatatggaacacaagattctgaaacaacaaatctgactggcagaataataaatagtgctcttaaacagcaggtgttaaaaaggttgtgaaaatatgattgcaagtcataaaatatcttagcacctaaaatgttcaagcactgagctatatcaaattttcaggatctgtcctcaaataatatgtagaggcatgtaagttgacaaagaaagagagaaagaaagagaaagaaagaaaaagaaagaaagaaagagacagaaagaaaggaaaaaagaaagaaagagagagagggagggaggaaggagaaaaaaagaaagaaagaaagagggagggagggaggaaggagaagaaaaagaaagaaagaaaaagaaagaaagaaagaaaggcttgtagtgctcttatataccagatattagctaagcatcctaaaaggtttttgtttgttttttttttttttgagacagggtctggctctgtcacccaggctggagtgcagtggcacaatctcagctcactgcaacctccaactcccaggctcaagggattctcccatctctcagcctcctgagtagctaggactacaggcatacccgcctaatatttaaatattttgtagagacagagtttcaccatgttgcccagactagtctccaactcctgagctcaagccatccaccggcctcagcctatcatagtgctgggattacaggcatgagccaccactcctggcctctaaaagttaaaggataataattatattccttaatttaaaaatagatagatgtactcattctcatcttatatttgaggaactggcttgggaaagttaagtaatttacccaagtggacacagccagtaagtaataaaccagatattttttccctctccaatttcttttctattcctcttaagttttcctttaaaataagtacataataggataacactgtttataattttcaagattgtagtaatttttgtcacattttctgtaatatttttcacttgataaaatttgaagaaaattacaattatgataatcatctttatgtatacaagactcagcatataatgaaaaatgttatagacaaaaagcatcacaaaccacactcactcatttccatctctatttgaaaacaaaagctatggccctacttggatgacatgcatgaagcccgcaaagctaaggtaaatgtgtaacttttccaaaagaaaatggacctatttgggaaggttggaattttaccaaaaaattttaatataaagaccccttcaaagttgcttgttggatggaaaatcaaaagaagttacaggatatcaaagagagtgtggtaagttcatgtatcctggaaattattcagctatttcataaatttaatcagaggagtggaatgtaattaccatgcctgcccactgatgtcgtcacttttgaatcactcgtctttcttcagtatttttcagtaaaacatagtagatttctcagctctgccgctttctgtcaacacacatctgcacaacagtattcgtaacttctcagcaacctagtttttaagcatctgtctatccgagtacatgttgaattgtaaaggagaatttctattttgtgatgcccttcagaaaacaagaaaggcagttgatactttcaaaacctgcaaataatttctaagtaaaagttttgaagaaaagtcttctcactctgagctcagatagaaaacatgtgatgttgtgtatttcatttaattttgctacatgaatgaaggatacaactccagatggctttgtgactcatgattttctgtgtgaatacccatcagcatcaatgcctctgctaatgaggccaaaatgcattttcctatagggacgaaaatcttaactttataatctgggtcaaagaagatcttgattaaataaagtctctgaagaaacattagggtgatatatctttatctattatgtagagagtcagtggtttcttaaaaataggacatgtcttaaaacatacctttgtatataaataattgttttttgaaaagagattggtcaatttctgaataattcaggaagaatgaattcttccagtgcctcactgtcttggatgattttgaccatatttatgagaaccctttttctttctttaagaccctgaggtcaccattatggatgctgtttaaagaaccatgtagtcttttccatcctgccactctggaagaagagatcgagagctcaattatgcaaactttgcaaagctggtaaaagcacttcttcaagatggaattgacaactacaaagtcttgtcagtttctttgtggacagaaatccccagatacctgaaaacaaagaacattttaaaatgtttccttcagatgaatttaaaattgaaatgtggattcataataccttctgtgctaatagagtcagcatccataatacagcccctatccaaattgactttagcaccaaggaggtaagaaaaaggaaatattgtgccattaatttaattaaaattagtcgagaagaattctggcattatttggcacaattctatctttatctgaaaaaagtaagtaggaagtttctgcttattgtgtatatttgaatctacattcttgagtaggattttgtatttccaaaatcataaaatgtgcaaaatgttgtatttctttatgttcattattatcagaaggaggtacttacgttttatcaaaatatccaaggaaagtgtcactccaaagtattcatttcctcaacataattattttaaataaaataataaaaatacagtataattgtaaaaataatatgcatttatatatcattttataattcattacagtaacagtatgagttctgatttcactttttgcacttgagaaatgagggacttaagaaaattagacggcttgtttagggtaggtaaggggcagatccaggtattaacaagcgtcttcttaccctaaagcatacactgtcctgatttcctttaaggagaggtaagtaaagggcccccagagctctgagggaaggcttgatcctaagtggtcccttagactgagttttaaaggaagttagtgtttgaactgaggcttgaaacaagacaagaatttcattggaaaggggaaaaaaatccaattcatggtaccaaaataagcagaaactaagaacagtacttgtgaagacaggctgagtcatctgatgcagctctttctatgagtttttgaaaaattattgttacggtcatctcattttgagaaaggaggaaaggaagagcagatggcctcgggttggggaatttcctacaatatattgttataattaacttacttcggctgaaactaagattagagattagagagcgtatgcttaggtggtagacatatttggtttatgatgttctatgcatcagagacaatttgtaaaaagaggggaatgttaaaattttgaatatgattaagctttgtcagcctaagtgtgttagctattaactgataatgattagggactcattttctccaagctgtctttaggcatcattgctaagccagtagccattcagtcctccttccatgctggcagagcttcggtttgttcacttgctcctttctcttcctaagactcagagtcacatctttattagtgtaagccagtcatttaggtctcatgtcccttaacagcactttatttgggaatagatattcattgcaattttggccaagaaacagaagtaaactgctacaaccaactttttaccaggagagagaaaagccaactaatgactaatggagaaaatagtaggaaaagaaacctggggcacttggtgacatcagttcttcaaactacaataccttgaggaatttcttagtgagctaaaacacattccttattttataaggtgattccattagagttttctatgcctcgcaacaggaagcattatcactgacatgacctgagtgagactaactccaatgaaacagaatcacagcactaaaactgtcatttattatgtacttatatcaggaaaatgtacttaaatgtacctaaaaaatgtactttaaaatgtgcttaaaacacaaaatcagtagtaagatataacagcaaattaaggagaaaagtaaacatttatactaagaagggaagttcagaaaggtaattggggtttttctatagtggaatattagccttgtattttgggaagacagtcctgacagaatttctgtagaacagtataaaaactggaaaaatgtaagatatatcagaaatgtcagattgataataaccacgattctttttgaccacagggaagactggtagactaaagatggctgcacatatttagggaaaccccattgagagaatggggccttattcccccttcccttgaatctgaggtaacctgtggctacttttgaccaataaagtgtggcagatgccatgacatcatgtggttctcagtcttgcctttaagaaaatgggcagcttccttcttgctctcttggagtcttttgggttgctgtatcagaagtccactctcttggtaagaccacaaaaagaagctctgagttgacctcagcagagagaatggcccagatgagcccattgttccagatgtttatgccaaatttcaggcatgtgagtgacataatcttagacactccagacaaacttaataaccagttcagtaacaccaagtaaccccagaagaggccacatagagcagaagaattgatcaaattcttgatccactagtgatgagataaaagaattgttttttgaagcccctgaattttggggattttttgcatttttttgttattgttgttgctttgttagcacatgggcacggtggctcatgcctgtaattttggcactttgggaggccaaggcaggcagatcaccccagttcgagaccagcctggtgaaaccctgtgttttgtaaaaatacaaaaattaacagggcatagtggtgcatgcctatagtcccagctactcgggaggctgaggcaggagaaacgcttgaacctgggaggcagaggttgcagtgagcctcccagcctgggcaacagagcgagactccacctcaaaataaataaataactgaaataaatatagacaaaataaatgtagttatgaattcttaggttattgtggttacttaaacccagtttgccaatggactgaggacattaagaataaaaaaaggcaagataactcaagaaatggtaaaaatttaatattgatagaatttagtgatgcatgaaattttgatggtccagtgaaggagagggaggtgtgccagatgatcactttatgctatcctagaaggcagaaaatattctctcaattgtcttaaccagtatctggaactgagtagaaagggcacatttctaaggaagaggtgtagaataagtttcacattttctgagaaatcatttggatgtccatggaaattttagagttcagaagataaagaaaaccaggctgggcgtggtggctcatgcctgtaatcccagcgctttgggaggctgagacgggtggattgcttgagagcagcctggccaacagggcaaatcctcgtctcaactgaaaatacagaagttagccgggtgtggtggcaggcacctgtactcccaggtacttggaaggttgaagcatgagaatcccttaaacccaggaggcggaggttgcagtgagctgagaatgagccacattgcgctccagcctaggtgacagaataaaactctgtctcaaattaaaaaaaatacagaaacaaaaaataaagaaaaccagagataatgtttagaagttatagacaaggcaaatttcaatgcacagaaatattttaatcctcgtaaaaatggttgaataaaatgctgcttatagcagttcattcatatagaaactatatattttatactatttcactggactttttcaaaattttacaaagaaaaactcagtcttttaggcccacctacaccaaaaaaatagcattcttatttactctcttgggcattagctacaaaaaatgaagaattgtgttagtttctgtgatttttttaatctacagaaaaattgtgtacttaaaaaagtcaagtatttaacctgaattatttctcaattgaaataaactttctttaaaaatctataattttatttaggctgctgtttaaactgtagataaaggtgtggcaaatgtataattatgcatttcattttcttctattttttatgaacatgaggcatttttcgttatttaaatatttaaagtttccttatattaaagtatattaaaacacaatttagatttaggattgactgagccacaacttgttcaagaatattcgaattatttttccaacaacagttttagacaaagtttgattctatgatgaatgctctttcaatggaaataaatcatactactgaaggtaaagaagtctgttattgaggtcaattaccacgtcagggtgtccttgaagcctcagcaattgaatggtcatgtctatagcctggagaatgtaaggctggaaacatatttttgatgattatgagcaagttagtgtgaatggtgattgcaacaagcagaactgtaggtctggaggggaaataatagtcaccggcggcatcttccagagcactaacaaacaatgattcctggcaagaatgactatatcacattttgtagaaatacagatgaatttcaagcctattctaccagcctaaatttaagaattacctggctttgttcaaccacctcatgaatgcctctcatgatacttaaaactaaataaactttatctagagatctttctgcataaaatttctgcttctgtttttcattttttcatatacacagacacacaaacacaggatgtaataataaaaaaatcacatgacttaattcataattgtcattaaatataaccaaatgctaaaatttgtatgctatatgcatagatatatagatacatagatatttatgtatatgtccatctatgtggatcagtaagatgtaaatatatatatatatatatgaaattatgcacatacttagttttacattggaatttttctgattctaatgcaaggacaatatatatgtatatatattcattaattcacacatatattcatatatatatatatataagttttcatcagctatgaatatatggcagataattcactaaaaatgaaactttccatcgtaaaattgtaggcatttatgtgaaataattgatcttgaattaatgtgagaaatatacttgtttccttccttctaccacaaaaagtacatgaggagcagttagatacctataaaactgcaaataacagagaaattttaatatattattcagatgcccaacctctttctatagctctcaagtccatctcaaatactagtcccaatggctcttggtatatcgatttagatcagagcctctcctctaaggagaagccatttggtcttaatgcttctagacctcacagaggttcccagtctcctggccccagaatactctgtttttacaggggcacattgcaaaacctgaactttcaggaaagggtgagaacgttttggagatgcttcagagtaactgtaaaaggagtgtgagttatgggattgcttgtcaaaggagagtcatagcatggacctgcgctcccattacagcttcctgggcagctttggatcgactgccattagaaggtactattagtccagcaccttgatcttggacttctcagcttccagaactgtgagaaaataaacttctgttctttatgttctttctttctttatttttttaatagacggagcttcgcacttgttgtccaggcgggagtgccaatatccctgatgaacatcagtgcaaaaatcctcaataaaatactggcaagctaaatccagcagcacatcaaaagcttatccaccatgatcaagtgggcttcatccctgggatgcaaggctggtccaacatatgcaaatcaataaacgtaatccagcttataaacagaaccaaagacaaaaaccacatgattatctcaacagatgcagaaaaggcctttgacaaaattcaacagccgttcatgctaaaaactctcaataaattaggtattgatgggacatatctcaaaataataagagctatttatgacaaacccacagccaatatcatactgaatgggcaaaaactggaagcattccctttgaaaactggcacaagacagggatgccctctctcaccactcctattcaacatagtgttggaagttctggccagggcaatcaggcaggagaaagaaacaaagagcattcaattaggaaaagaggaagtcaaattgtctctgtttgcagatgacataattgtatatttagaaaaccccattgtctcagtccaaaatatccttaagctgataagctacttcagcatagtctcaggatacaaaatcaagatgcaaaaattacaagcattcctatacagcaataacagacaaacagagagtcaaactatgagtgaactcccatacacaattgcttcaaagagaataaaatacctaggaatacaatttacaagggatgtgaaggacctctttaaggagaactacaaataactgctcaaggaagtaaaacaaatggaaaaacattccatgctcatggataggaagaatcaatatcatgaaaatggccatactgcccaaagtaatttacagattcaatgctatccccatcaagctaccactgactttcttcacagaattggaaaaaactactttgaattgcatatggaacaaaaaaagagcccgcatagccaagacaatcctaagcagaaagaacaaaggtggagacatcacactacctgacttcaaactatactacaaggctacagtaaccaaaacagcatggtactggtaccaaaacagatatacagaccaatggaacagaacagaagcctcagaaataacaccacacatctggagccatctgatctttgacaaaactgacaaaaacaagcaatggggaaaggattccctatttaacaaatggtgctgggaaaactggctagccataggcagaacactgaaacttgatcccttccctacaccttaaacaaaaattaactcaagatggattaaagccttaaatgttagacctaaaaccataaaaaccctagtagaaaacctagtcaataccattcaggatgtaggcatgggcaaagacttcattactaaaacacgaaaagcaatggcagcaaaagccaaaatcaacaaatgggatctaattaaactaaagagttctgcatagtaaaagaaactgttatcagagtgaacagacaacctacagaatgggagagaatttttgcaatctatccatctgacaaaggactaatatccagaatctgcaaggaatgtaaacaaatttacaagaaaaaaataaacatctcatcaaaaagtgcaaaaagtgggtgaaggatattaacaggcacttctcaaaagaagatatttatgtggtcaacaaacatatgaaaaaaagctcatcatcattggtcattagagaaatgtaaatcaaaaccacaatgagatactatctcactccatttagaatggtgatcattaaaaagtcaggaaacaactgctgtggagaaataggaatgctttaacactgttggtgggagtataaattagttcatccattgtggaagacagtgtggcaattcctcaaggatctagaaccagaaataccatttgactcagcaatcccattactgggtatatacccaaaggagtataaatcattctactataaagacacttgcacatgtatgtttattgtagcactgttcacagtagcaaagacttgaaaccaatccaaatgcccaccaatgatagactggataaagaaaatgtggtacatatacaccatggaatactatgcagccataaaaaaggatgagttcatgtcctttgcagggacatggatgaagcaggaaaccatcgttctcagcaaactaacacaggaacagaaaaccaaacaccccatgttctcactcataagtgggagctgaacaatgagaacacttggacacagggaggggaacatcacacaccggggcctgtcgggtggtagggggataagggagagatagcattagcagaaatacctaatgtagatgatgggtttgtgggtgcagcaaaccaccatggcacatgtatacctatgtaacaaacctgcacattctgcacatgtatcccagaaattaaggtataatttaaaaaacaaacaaacaacaaaaagaaaaaaacaggccaggtcaaatatatctgcaagctgagcttccaaactcgtcctcagtttaagggctcagataatcaacacgtctctaaacccaggggctacagaccgaattgtgtctccgcgaaattcatatgttgaagccctaagctgcaatgtgatgatatttggagatgatgccatggtgagataattaggtttagatgtggtcatgagaacaggggcctcatcatgggactagtgctcttctaagaagagaaggagactaaagcttgctggcttggctctgtgaggacacagcaagctaggaagagagcctttgccaggaactggatctgccagcaccttgatcttggacttctcagcttccagagccgtgagaaaataaacttctgttctttattttattcatttatttattttttaatagacggagtttcacacttgttgtccaggatgcagtgcaatggctcaatctcggctgaatgcaacctcctcctcctgggttcaagagattctcctgcctcagcctcccgagtagctgggactataggcgcgtgccaccacgcccagctaattttttgtatttttagtagagacagggtttcatcatgttagccaggatggtctcgatctcctgacctcatgatctgcccgccgtggcctcccaaagtgctgggattacaggcatgagccaccatgcccagccaacttctgttctttatacaacaccagatctatcatattttgttatggcagcccaaactgattaataaaacagcagcgctttagagtcaggtgttttagtttttctgggtgccagagttaaggtaaaatgccaggcatttgactagaaacgaggtttcaaagcctgatccatatgtagaaaaggaataaaaataattgtacgtgtatctttggaaagaaaatggaatgaagtcaaagcagacttattagtgaaacacactaaagaagcaaggaatagtcagaggtatcaagacttctccactgcaaggagctggatgcaagaacaggatctggtataccatgcttgaggacatcagactggctgtcctgaatgtagttaggaggccagcttcggagatactgagatagaatctggagcatgctttggagatattgatgtttcatatgcatgtgaatgaaactgtgaacagggagagagctgctaggaacactggtggtttttcacacttggaagtggaagaagacctactaagggaacagaagtcactggctcaatgtaaagcagcaaatcatctgggaagacctgtgaagtgtcagaaaatctttaggattcagggtgacaagaaacacagggaaaatgctatggaatataatttagaggaatgcactgatgagaagactagacagaatttatggcctgtttaccacgcagtgagagcactcctttcagacttgggcatctaagaattcaacaatctaaaacacctagtaatcctgataaaatgtaagaatcattcttcatattgctagctaaccttcaagaaataaggtaacgtcatagaaaccaaatttaaaaagtagcaggaatccagagtaatggattaaagctcaagcttgtctctagggcaattcgccagaactcactgagtccctagatttgtttcagcaaagctgagcctttcatataatcctccgttgaagggagaactggaggatggatatacaggatggggtttgtgtgtgtgtatgtgtattctagcagtacgtactctggtgacaagagacatcaacaaagcttgtctcttgtagcccatgtgctggggtaaactatctttccactggaaaatttacactgcccttcttgatcaaagttaagagtcagatttttattgacaatatgaccaagtaaaatcacagtcacaaaaataatgtaaaagggattacatttatagcttcataggttctttgcaaaaggaaaagcagatcctctcaggtggaacaaatgttcaacgcaggcttcctgcatctcccataaataaatcttcatggatctgagcttactgatcaagttatcaaacagagagagacataagccaacatcacccagagacgttagaattaatgaagagcagaaggagacccccaagaatgttgattttagaatcagggttttaaagtgtctacagaactaaaagttaagcactatcccaaatattaggcaaatacgaaaaagcaaaatagagtacttttaaaaatgaaaataagcgctaaaattaagatcccaaaagactgctaattataacttactaaacagtgacttggtgaaataggtattaaacagaattcagttaagtgagaactacagaatcttaatagagaggttagaaaaatgcagatttaatagtgagatatagtattataatagaaatgcaaactacacaagaatgtgaactgtattagagacattcactattatgagctatataatatacataatagatacatgtttgaactttcagaagaagcagagagaaacagtagcaaaaacccatgtttaatagcattttacattttttctagaaataattttaaatctaaatctttaaatttgggaactattttaaaaaacaatgttaccaataaacagagactagcagattggtctgttgtattaaacctacaaattaaaagccaagaagaatattataaaagcagccagagagaaaagaaaaaaggccctaacccaagactgaccattggaataagagaaatctgcaaatcacaggagtttaaagcagaggatagtcgagttataaataaagaacactgaaatagacggggcggggtggctcacgcctgtaatcccagcgctttgggaggccaaggcaggtggatcacctgaggtcaggagatcgagaccagcctgaccaacatagtgaaattctgtttctactaaaaatacaaaaaattagctgggcgtggtggcgggtgcctgtaatccaagctatttaggaggctgaggcaggagaattgcttgaaccccggaggcagagattgcagtgagccgagatcacgctattgcactccagcctgggcaacaaaaacaaaactccattccccccaaaaaagaatattaaaataatagccattaatctagaacattaaaattgctagtatatcattcaagaaaaataaaataaaaactgtgacattcgcaccttcttccaaaaatgaacttctaaatgttgtgctataggaagactacaaaatctgaatacacctatattcattaaacaaacagaattaggaggcaaaaataagtttaaaaattggtcctgacgaatatttaagagagaaaagttgcaattggatacaaaatctgccaaagattagagaacagtggaacactctaaaattcatgtcatactagttataaccttaaaaaacaaaccaaaacaagatgagaaggtaaatgagacaggataggctaggctgttttgcatacattatttcaatacattctcagagctaccctatgagataagtacagaataattatttactgttacagataaagaaattcaatccagaaatgtgaagttacttgtcccatgctacgcaaagcagagacaggacgttaacgtagttttatttaagagactgcaattactaatgtgagacgaatatcctgtttccactcctttttaattatgtaatcttgggcaagtaatttaaccttcccaagcttcaatttcttcctctataaaaggaagtatgtatactaacaaaagaagttttcataattattaagtgtaagtagttttgaggattatatgcgataaaggaggagatttaaatccatataaaatctgtaagccagcatctagtggaaaaatattaaataccatttattaataaattattaatgtatgaatttttattattgtgctctactcaatattgtaaatgtgtgcttttttaaaaaaaactcaaatatatttaggctagaatgtttatctacagtgaaaaacgagaccctctaataacatgaatctccaagatttcctggaggggctataaactaagcccaagctgcctaccactcagcaagtgctgggcaatttgtgattatatgaacataccatagatcttattaacagtgtcttttcaaggtttcctattttaaataattctttctatatgtgtaaaattacaattgttgtcttttacaagatggtctgagagtaaagggggacttttaaagatatggactgtgaaattgccattaccctgggtttcactctgtaatcattatttttccaattagataaatttcacacatgactacagaaataatgatgtgaaaataatttttttcctatttcaagaatttcgagtgtttttgggaggaggttatataatgaagaagatagtagctctaaaataatatattggcatactggaatcttaagcttcatttctgcaaatcacatactttattcctttgattgaagaataggcctaagttcatagaacataacagggagaaaaataagccttatttttaaaaattcagtttatgtaaactgcctccacgtaggaaaagatgtgataattttaaaaacatctacctaacagataattaatattgtacaaataattgaaaacaatattagtattttgtggatattttaaaattttaattgtactcatattgcgttcttaataattctgatgactttttctaaactatgtctaactcaactgatttgctggacctgatactctgggctaatgtccttgaccaccttttcaatgaaggataggttctagagaatacaatctaaatcatggcaatatgcaggattagggctttaacaaaataaatccacatcagcacgatcctgcctcatctcattcatgctttgcctgctcttcattatcccaactctgctgccatggtaattatttatgctgtgaattattgtcatactgttaaatatagctttgaaaatgacaagaccaatcttttttatttattgtcaaccaatcaccctgcctagaatcaacaaaagtaaatcatatttctgttaagcatttactgaaaacattgcatattatcacttaacttcttggaggagcagagccaagtgggaagctaaacaatgggaatgaaatggctcggattctcctgtctcaaacaccctttacaataggtatgaaatggcctaaaactgacactttatgattccataataagaaacaagaaataaatttctgatcgtcatccctatacctgcctctccctcagattctcccatctcactttttcttttactgcacaaaggagttctttcttcaaatctatcccacctctgacctcttctcttcatgtgcactgctaatattctggagcaaaacgctgttgtgtctactcagattcttgcaataaccccataacacatccctcttcttctgctttggccaccaatccatctattctcaatttggtaagcacagtgaccacatggaaaaccaaatccttctgtctgaaaaccctccaaaggttttctagttctagaatttatctaaagtcagcctaaaagttcaccaggccttacaggacctggtgcctgccctccaaaacctctctggacccatttcctacaattcactcttgtttgctctggcccagctatatcagccctctttctgtcactgaaaaaatgcacatgctgatgaacagaagagaacactgttggtgggaatgtaaattagtacaacccctatggaaaatagtatggaaatttctcaaagaactaaaaatagaactaccatatgatccagcaatcccactactgggtatctacccaaaagaaaataaatcattatagcaaaaagatacctccatttgtatgtttattgcagcactattcacaataacaaatatttggaatcgacttgtgtccaccaatggaagattgcataaagaaagtgtgatatacacacacacacagacacacacacaaaagaatagtaatcaccatgaagaagaatgaaatcatggcttttgcaacaacatgggtagaactggaggtcattgtcttatgggaaacaactcaaacacagaaagacaactacagtgtattctcactcataagtctaattaaatagtgtgtaaatatggaagcagagtatagaatgttggacaatggggacttggaagggtggggaggtgggacagggtggatgataggaggttgtttggtgggtacagtgtgcattgttctagtgatggatgaactgaaggccctgacttcaccataatccaatataacaaatgcaatataatcaatgtagcaaaattgcacttctacctcatgaatataaacaaaaaatactaatgcacttgcttttacttcactgggtattcctcttccttcaagataccaacatgggtttctatcgtcctttacttccttacacgtattattccttcctttgaagtcttcttcactgcactcttacagatttcttaaaaaacaacacacacacactcctcacattctctctttccctctctctagccccttcatgcttgatttttctcattgtggttatcatcattgaacttactgtaattgtacttactgatttttcattaaagtctgttctccctattttcacaactaaaggtaagccacataatatcagggattcttgcctgttttattcactggtggacttccagtacctggaatattgccaaacacatgttaaccactcattatatgttgaatgaatgcatgaatgtgaatgcgtgactgaaaaattgagaaccttccccagcaacactcaaatcagtcatctgtgtcactttcctttatgaaacatataaacatatctacgtctggacccatcctctcctcctgtgccttgctataacttttcagccaattcctgtacacttgctatgcccataatgagtatttgcttacctaaaaaggaactttaagcttttaacttctgaacattttctcatttattaaacttcttttagttctcttctcccccttacccagctgggattacattactctattttactaaaccttctttcagtaacctaacctccctgcctctcactctttttattgtatccatctagcaaaacagaaacctagatgaactaattctaccagagacttcctccatgcttaatctgggctgcattggataattcaagtgctcaatcttattggcagtcctattacatgagtcaggtcaattctgatcagctctgcactagacatttctgtttgcatgtcttaaaacacaaacatgtaaatgatagcacagcaaacattcagggaagacaagatatttctaatgaaggccagtaatggattcaaaatgaattaaaaacaacaattgagcagagtccaaatctaccttagagacatctaggataataaaatttttaggtgtcccctgtatggtttctttcatacttctgtgacaccttaattagccatggaactaaaatttcacgactaacgttctttaactattaaaacaaagaaagagaaactgattaaaatgaaaatcaaacaaatacacttgtgacatagcctatactgcaatattgattaatataaaactagtttattatcattaaatcaaaaaatttgaagaatgcatgttcattcagttcctaggaaataacatattttaaatatttctccagctgaagctgattttttcttcccctgtagatcttttctgtttaataactcaccaatcttcctcagtgccagatcttagagacttaaccctcaaacagaggcaatctcatataaattaaaggccaagcacacactgcactccaattgtgtgttacatccctcaggcacctatgggtttatttctcaaatccactgcccattttgtttttattgtcacatcccataacataaaacatatctaatcaataaaatcagaaaaatataatacataaaatgtttcattactatttggcaaatggaaatttaaaaatgaaatatataaaaaacaaaaacaaataaaaatacaagaaataggaacacttttacactgttggtgggactgtaaactagttcaaccattgtggaagtcagtgtggcgattcctcagggatctagaactagaaataccatttgacccagcaatcccattactgggtatatacccaaaggactataaatcatgctgctataaagacacatgcacatgtatgtttattgcggcactattcacaatagcaaagacttggaaccaacccaaatgtccaacaacgatagactggattaagaaaatgtggcacatatacaccatggaatactatgtagccataaaaaaaagatgagttcatgtcctttgtagggacatggatgaaattggaaatcatcattctcagtaaactatctcaagaacaaaaaaccaaacactgcaaattctcactcataggtgggaactgaacattgggaacacatggacataggagggggaacatcacactctggggactgttgtggggtggggggagggaggagggatagcattgggagatatacctaatgctagatgacgagttagtgggtgcagcgcaccagcatgtcacatgcatacatacgtaactaacctgcacattgtgcacatgtaccctaaaacttaaagtataataataaaaaaaaatacgaatttagagttgcatgaaatattagtaattatataacaaaatctgtttaatacaactggattaataccaaatatcaattgataaaataagtaatagaataaacacctgttggtgctccaaacttagttgaatcagagttttctaaaaaatattaaaatagcttgggcttctggagatatggctaccagattaacagcttgatcaaacctatagaataagttgggagtgagatctaattagcctcacattgcatttgaattttttaaattatatttttaaaaacttcttaacgtaaatagtagaatgctatcttcatttacttgggcccctataataaagcaccatagtctaggtagcttaaaaacaacaggaatttaattctcacagtttggaggcattagacagtccaagagcaagtttccggcagattttgtgtctagcgggtgcccactttctggcttgtagttagccttcctttggctatagcctcacataacaggaggggagaaggaattttctagaacctcttccttaaagacattaatcccattcataagggcttcattctcatgacataatcatctctcaaaagttccgcctcctaataatatcaccttggggaacaggatttcaatatatgaatttgggaggacataaatattcagtccactgcaattacattttttctggtaattgtgtatttttttaaatgaggcgaaattcatccaaataaagacaaagtttctatttttcttactaaaaatatagagaagcattatttccttagccaattgaaagaacattgattgtattatacataagcatcaaaaaaattcatttacattaaacatatacctgtatgaaaataacagaaaacataatatttgtgttctttttattgataatcctatggaatttgcttatatatgtatatttttattatacatagtgatttttccttactctggcactagtctagtattaataaaagacaagtttgttatctatttagtatattcttgtctctgagctgatcaagataagaaattatttttggggccagtgcagtggtgcaggcctgtattcctagcaccttgggagactgaggtggtaagattgcttgagcgcaggaatttgagaccagcctggccaacatggtgacatggtgaaaccctgtttctataaaaaaatacaaaaattagcccagtgcgttggtgcacgcctgtagtccctactacttcagaggctgaagtgggaggatcccttgatcctgggaggtagacgttgcagcgtgagccaagatcatgccactgcactccagcctgggcgatacagccagattttgtctcaagaaaaggaagaaagaaattcttctcaggtttaatttcaaaataactatttttagaaaagttttatttgaatttagctactttaagaaatattgtggctttcccacctataaaatattcccataagtttgagtctatatgtccttctatagaattatgtcacttatattaaatgcaattctttttagtgccttagtgtcttcaagtgacagatctgtcagaagctcaaacctaaaacacagactgaaaacataataagttttactgtcctatgcctgttctgtaagtttcctcatgtttcttgcaataatcataataaaatgataatgtgtaatataatgaattcctgctctaagaagtaaaaaaataacacatttcttgcagagtggtctcatgctaagcatgaaaactgacaacagcaaggtacttaaaaccatcaagcctgatagagtcctgatgtggtcagctgggccacctggcagccaggccttacatgctgtaaccacaaggcttgaactccagcctcctgttcacacaatgggaggggctgtgttcctgaaccacggcaatggcgggacagcagattaggccactgatttgtcttgtacatctgcaaaaaagagtcctgatcaatccagagaatggtatcacatgcttcttcccatgaaggataaactagcaaagttgggccggagccaagtatttgccacagtataatgtggttgaatcccaggccctgacaatctcaggggcaggcctgggcctctttcagtctcatagctcaggaagtccttcctccttctcccagggcctactgtctgaccctgctgggtccctgtcgtctgagtcagagtaaaatatgtaataggagatccaaatacctactttttatcctgcttccctgttgccttagtaaacctgttgccagcaagcctgatgtgtgtgttgtcaaataaattatatttttagttattaagtgacaagacaataagaagccttttctagcttcagaggagaagttaggcatcactcagagatcctgagctttaagttgagtgtggtgactggataggacttgggttgtgtctctgaataagggtaaaaatgtgttctatgtgtgggaattagaatgcacaaagattttctccttttatattaagcagagtagtagttgggaggtggctgcccacacaggagctgtacatccatgcccccttgtagctagatgtagtcatagcactgattcctctcaaaggaatgagagcaaaaggaatgtgtgctgttccaaggcaaagggtttaagatgcaagaatggagtgcctgcccgaggtgggtttttttttttctactttaccacttggaaacactcaataaggaagccctaggaaattatggaatcatgtaaatgaagaagcctgggctgctgtaagcttgcatggaaaagaactgtctctgaagatgaaaaatctcttagaactgttacgtaagacacagatgtctgtggtcccttacatatttgagtctatttatttttacagcctgaattcaagtttaactgaaagaagtctgcttgttattttattttatttatttattttgagacagggtctcactctgtcgcccaggctgagtgcagtggcacaatcacagctcactgcagcctcgaactcccggctcaagcaatcctcccacctcagccttctgagtagctgggactacaggcacaccatcatgctcagctaattttttatttcttatacagtgtagggggcacactatgttgcctggctggtctcaaactcctagactccagcagtcgtccctcctcagcctcccaaagtgctgggataatacgtgtgatccaacatgcctggcttacatattttattaagtggacagacttggtactatttattagtattcattggatgatcacatgatccaaattcataaatatcaggagagcagttataattgggtaaagtgaggaaacacatggcatatcccaataatatagatcatagaaaaaatgaaaagagggttagtgttactgcaaagaggagagtaattctagaaaggtagttcctattcactgatattctgattttccaaaacattagttagtaacaatgtctaatgatgagataatctaactaatttcaatattaggtgtactttaatatatgtgccattataagtcaccagctcattagttctaatatgttagaacttaaagtcttcaattagactgcactgcaatctaggacagctaatagattcctctctctctctctctctctctctctgtctctctccccctcactccctccctttctcttttataataaataattttcctgattggccattcagttgagtatgtgagtcccatttgcaccaattaacacatccaccagtttggagctcccacccatttaaatggtctgatattctcccaggattcctctctctatgtggttcctccagcagcctttgcgctaggtcataatctgtcatcaccactgggcctagctctgcatcctctccaggctgttctccttttgcccccttaatggaagttcccctgcagctcccttgtggcggccggagaaaggaattcaattctggaattccatcaatatctaattcttttttccttttctcacatcttttctcaagttcccaaaagttcagctatggctcagaaacccatagtcagtcatcagcaaaatgtcctatatttctacccctgtgtcattgcttacgtctcccagaatttcattcttccctgcagccgtggatgtctactgctaccagtgacacgtgtgcaaccaatcatgtccagggctctcaccttcactaaccagcataaaaatgtctaataattctctctatccacacttgcagaaggaattctcaaaatagaggttataaactgatcttgcatcacagtgttttttttttttcccaaaaactctcccttctattatctaaaatgggtgaggaaaggagaaaagttgggttaaaagatacttggaggtagtttcccattgtgtatatgaccacggatagcagccaagatggatgttcaggcagtctcgttcccacatacattttcacgtgtgataatttagtttcaaatttctcatttttcttacccccagcttgaacccttttgaaaaaaccttagtacatcagataatatgtacgtatttgattaccaggtatcacagagcaagatgtcacaatgtccgctatcaagttctctgcctcagagctgaaagcaggatagaaaggaagctacagaaatctgtgcgccacagatagttttcccttagatccactcagctttcagcaaactggagaatcacagacccaaagactactccaaggagtgagggatttcccctcagacagttttcacattaccctttacaggggtgcatatggagctcagtagatctgcatgagtttcaaaatacaacctccactctctggacaacccactcttagagcttaggcatcactatatgcctgaaacctgcagaactgatgccattatatcctttgtcctattttaaatctgcccacttcagagatcctaggaccaacgactatccatttattctggaattctctcaacatctaattattttttccttttctcacttctcttctcaagttcccaaaacttcaattatggctcagaaacccatagtcagtcatcagcaaaatgtcctatatttctaccccttctctaactttactttccttttattgaagcctaattccctaaggaccacttccctgcactgctggaagtagcatcggtcttctctcccatggccttcataactgggcctggaggtagaattttgatattctagttcttcatcattttccaagatcatcacattcatgccaacagattataccatgcactgcatctctgtgtctcactcttctgcaaaaccactgtgtctcccactcatttcctgaagattctaactcctggagttagaatcactatcttcatagttcatgtcataattaatgatgatttctgtatccatttagtgtatttttccaaaatcctgcattcacagtttttgcccttacatctactgatgaccttgttctccaccctgtttgtctctcactccatgaccatgtgtctcgtcattgttaatcagtccaagtcttcttattatatcaacttcgagcatcccaattttcaaccaccaccacttacctttttagttcattccctgtaatacactgattccaaccattcttcaacctccaaaataactacatgcatcttactgccattttctgtgcattatcattcccttatcatcctcttatcatcctcttattcttacttctggtctaaaggcttggattttatggtacatcattattttcatgtcttgcactattctttatttttgttacctctctttttcttgtttcattttatacgcttttagcataattccagtgctgattaaattcacttctccacctactctgggcttgtcaccgtgaagctacatggactacatcattttttgatagacctcagtgtaaactcatgaccacaaacctcaaagggaaattattccacagtttgatagacaatttagccttttctcttacagataattttttatactctctctctcctcaaattcaaataccacatgccatcttccctcccaattgatctattttatgtataaaatgaaagaaatctgaaagaacttctaaaagctactttattactttttctcagctgtgatggttcacgttatgtgttgacttgactggggccacagagtgcccagacatttggccgaaaatctttctgtgtttctgtgagactgcgtctggatgacattaacactttatgggtaaactgagtatagtagattgccttcccttatgtgggtggaccttactcagtcaattcaaggcctgaacagaagagacaggctgagtaagcagaaactccttgcatctgaccattggtgctgggacatcagtcttttcttgacttcagacttgaaataagaaactggcttttcctgagtcttgagcctgtgggctttcagactagcactcccacctttggttctcctggtttgccagcttactgactctggatcttgggacctcccagtctctatatttgcatgagtaaattttttatcataaatctttcatgtagggcatcataaaagatggtatcattgtcttacttaccaaccacccaaaccttctcatcccaaagtttagtgtagtgttgatgaggagcttctagtgaattactcacagagattgataaccctgccaaaaattaacgtgctctggcattgcaaaggaatgtagtccctgcaaaaccaaggcagggatggaataggagaaataagaaccccacatctctgtccttacagtatcatctccagcaccttccattaaccaagcccagccagaagcctgagggcaggaagcacctggagtccctagggccagcctcccaggacacaaagccaggcagataagccaagacgaaaacaggagcacaagcaaaaccaagcaagcacgcacatcctaaatatacacatttggtatactcataaaaaaagcacacgttcatttctattcaattaaaatgccatctaaatctttctcttaatttatttttcaccatgacaaagcacttttagttctataataagtaaactggtaagtattgaacatacctattttgttctttagtattatttcaatcttgaaagtgaaatttttattatattcttatagataaaatagctaattttcaaaaatgagcaaagtttatagattgatcatctgtgcataaatctttggcttctttacatagttacattaaagtaattaattcaatacttatgttggcattcatcagatacaatcctgatttttatatacacacatatgtatgtgtatatatatatatatatatacacacacacacattttaatatatatgtatatataatgatttaaaattagttcctcaaaactatgcaagaatcatattttacctaatatggttgaaagtacaatataattgccttgataattatgatatgatttcctcaagatttgtggggagagaactttaaattttaaacacttacatataaaaataggaattctcttaaaattcatactttaatttttttattttacttttcaagtcaaaacataaaaataagtgtatttaagatttatttctatatatttgaaaatcaggtgtgcttaccttaaaaattactacaatgtaatttgtaagataatttgttttgcctcccaaatgttatgaaagcatgttattaatttaaataccatgggttaaaacctgttacagaatatgaaaacatttcacacttcttctaaagcataatttaaaaaatacaattgtggaattctctctcattttgattacctagaagatactattgtgatattgtgggtgctagcatagagctatattgtttctctctagttagatggctagggccaatgtgatacttaaaaaactgttctaaaacaagaataacgatgttacaaaattatcggcagtactatgttagcaatctcttttgagcacttgtgaatatatttccaggaaattctagcaacatcttccatgtgtataattgcacagactcagatttaactttttaaatgatctaataaagcagtcaaaattttagatttcttgaagaaatagaagaaaatatttttgtgtttctgtcataattatgctgttattgtttaaacattccttacagtgaatagactaatgtcttgaaactattatatggcaatagtcacattggcttttttccaacttctctattttatttatgtctaaccattttacttttccatcttgagtactttcttttattattgtaaattaacaaattatggttgtatatatttatggagtacaaagtgatgttatgattaatacaatgtagaaaatttaatcaagctatataacatatcattacctcaaatacttatttcatgtagtgaagacatttggaatttactcttcatgattttggaatgtaccatacactgttattaactatagtcaccacattgggcaatagataaaaaaaaaacccattatttcccccaaggctttaaaccctttcactgtcatctccccattctccccatttcctagcctctgataatcaccatcctttgtgttatgactttgactgtttaaattccaaacaggagtgggaacatgtggtatttatctttatattcctagcttatttcacatagcataatgttctccaattccatccatgttcaaatcacagaatttattcctttcataaggctgaatatattcccttgtgtatatgtaccatatttttaatgcattcatctgttgatagacactttgcttgattccatattttggctgttatgaacagttctgcaaagaacactggagtgcaaacatttctttgacatactgatttcaaatcttttgggtaaagacttggaagtgaggttgctagatcatatggtaactatatttttacttttttcacaaacctccctgttgtttttcataaaggctgtaacttacattctcaccaacagtgtacaaggattcccttttccccatatacttcccaacatttatgttttttatatatataatagccattctaacagaagagacaagctctggtttaattttcatttccctaatgattagtgatgttgagcattttttcatctagctgttgcctatttgtatgtcttcttttaagaagtatctatttcagctcgcttactcattttaaaatcagattgttttctttctatatagtcatttgggttttttatgcattttgaatattaaccttttatcaaatgtatagcttgcaaatattttctaccaatctatatgttatatcttcacttttatttgtttcatttgttgtgtagaagccttttttcttgatacatttgtctgtttttgcttttgttgtctatgttcttggagtccaatcttaataattattgcccatcccaatgtcatagagattttcccctaagttttattttgtaggtttatagttccaagtcttttgtttaagttcttaatccattttgggtaaatttttgtacatgatgtgagataagggtccaattttattcttctgcatatggatatccagttttcccaacataatttattgaaaatacagcctatttcccattgtgtattctggacacctttgtcaaaaatcaattgactgtacatgtgtgggttcatttctggactccccattttgtttcattgactgatgtgtctgttttatgccagtaccatgctgtttaattactatcagtttgtgatatagtttgaaagcaggaattttgaggcctccagctttgggttttttggtcatgattgccttggttattgtggttcttttgtggttccatatgaattccaagatcatttttttccatttttctgaaatatggcattggaattttgataaggattgcattgaagtagatcacttcaaacagtatggacattttaacaatattttttctttcaatccatgatatcttcttcaacttatttcattaatgttttataggtttcagggtacaggtattccactactttggttaaatttatttttaagaggttttctatctttttgtagctgttgtaaatgggattgctttcttgatttctttctcagaacgtgtgttgttagtgtatagaaacgctatggaattttcttgttaatgtatcctgcaacttttctgtatttgtttattagttctaacaggtttttggcaaattctttaaggttttttatgtataagatcatgtctctagcaaacagggacattttcacttctttctttcctatttgggtgctttttacttctttctcttgcctacttgctctggctaggatttccattactatgttgaatagaagtgataaagagtggttactcttatcttgttctggatcttagagaaaagagcttcaattttttcaccattgactataatgtgagctgtgagtttatcatagacggcctttattgtgttgaggtgcattccttctatacctaatttgttgagagggttttttttaatcattaaaacgtatttgaattttgtcagataaattttctgtgatatgaccatactttttttgttcttcattctattgttacaaggtatcacatttattgagttgtatgtattgaaccaccccagaatcccagggttaaacccacttgataatggtgaatgatccttttcaagtgctgttgaactcacttttctagtattttgctgaggatttttgcatctattttcatcaaagaaattagcctaaagtttccctttcttgtgatatccttgtctacatttggtaaaacgatgttactagtctcataaaaagagtctggaagtattctctcattttcagtttttcagaagagcttataaggattatgctagtttgaatgacatttgccccactaaaactaatattaaaatttaatccccagtgtggcagttttggggagtggagcctagtaaaaggtgtttgggtcatgggttacatctctcatgaataaattaagattaagaccctcccacaggggttagtgtgttcttcctcttgtgaggatggattaattatcactggcatgggttgttataaataatctggtttctctggtttctctctcttgcttcctctctcacgatatcatctctcggcacacatgtgctccccttccacttctcaccatgagttgaagcaatgtgaggtcctctccagatgcagctgcccaattttgaaccttgcagtcaccagaattgttagcaaaatacacttactttctttataaattacccaacctcagtctgttataacaacactaaatagactaagggattatttgttatttaaatgctagattattagatctttaaatggtagacttcagcagtgaagtcatcaggtcctgggcctttctttgatgatagactttgtttattattgattcaatcttcttactagtgattgatctattcaaactttatatttcttcatggttcagtcttggtagactgtatgtgtcttagaatttgtccatttcttctaggttacccaacttcttggcatataattgttcatctcactctattctctcctctcctaaaagctgataactttcatggcattaaacacacacacacacacacacacacacacacacaatttcaaagaaactgatttttaaagcatagaaaaaatgtgttgagattacatttgttataagttaaagttaaagttatcttagaagtatatatatatacacacatatatatatgttaatcattaacaacacttcaaagagatgacagtgatagtaacatgcccttgaatttcgttaaggtatatcttagatttaaccaagacacactagtttacaggagctggaaaatatattctaaagtgtcttttggaagattcgtagaaaatactgaaaatgcaaaatgggataatgtacataattttcttatttttcagaagttaaagggaaaagacatttccttgatcaaaatgaaaggtgaaagtaaaagtgaaacacacgagctaggcagagatggagtacaaagcattttgaatttagaatttgttttgtatgaagaattttttaagagatgctcaaataattaagtttccagagacaacatctttttccatgaagttattaaggctatgaaaagacctgtaaattttctcttttgcatttaagattactgggttttataaaattttgatgtctgctagatgatttatatggctggaaagcagacaacagaaaatatatattttttaaacagaataactcactttttatttacttaaaaacttataaaaagttaactgaaatattgactgatttgtctaggcatttcattaaacttgttaggtctattgggatacatatcaacccagcatataactaaataaagaagtggttatatgtgtcagtaaatacaattaaacaaattaattaatgtagacaattcaattttatttcaatgaaaaataagtaaaacaattctttttggaatttaagcaagaaataaggacttgatgcagcatatttaatagatttaggattgactttggttatttctgaactttctaatatttcaggaactaagagctgactgtcaaaattgttaatttagaatacttgtactttaaatgtgagtataatataatttacaattatacccaatacattatttgccatgtgtaaatcaagtaatcaagagtttcatatattcttatttttttttcaaaaagcaattacaagaatagaagaaaggtgatgtgattataatatactaatgacagaatttagtctcttagctgatgtttcatatgcttcaaagtatgagtgccacaaccatataataacagggaaaaacaactcatgatttacatttcttcatgaacaaaaccttaaaatgaatatcaccttaaggtcaggagttcaagaccagcctggttaacatggtgaaaccacacctctactaaaaatacaaaaagtagctgggtatttaagtgcatgcctgtaatcccagctactctggaggccgaggcagaagaattgcttgaactgggaggtggagtttgcagtgagccaagattgcaccactgcataacaacctgggtgacagagtgacactccacctcaaaaaaaaaaaaaaaaaaagaatattacctcaattatggaagtacttttaactcaatcttcaaagcatatataaaatgttgagattatatagtcttaagttagaggaaaagtggtacagattaaatatatatttaccatcaaataaatatctttattattctcttgtttttattggcttattgtaaatttctctctttattttccatatgcataatctacctgggtcaggaaaaaagatataataaataaataggagatacacacacactcaaaactgtgttttcattcttgaatatgaaaagataattaaaaacatccttattgaaaaataaaaagagagggcagccaagatggctgaataggaacagctccagtctacagctcccagcttgagcgacgcagaagatgggtgatttctgcatttccatctgaggtaccgggttcatctcactagggagtgccagacagtgggtgcaggacagtgggtgcagcacaccgtgcatgagccgaagcagggcgaggcattgcctcactcaggaagtgcaaggggtcagggagttccctttcctagtcaaagaaaggggtgacagacagcacctggaaaatcaggtcactcccaccctaatactgcacttttctgacgggcttaaaaaacggcgcaccaggagattatatcccgcacatggctcggagggtcctatgcccacggagtctccctgatcgctagcacagcagtctgagatcaaactgcaaggtggcagcgaggctgggggaggggcacccgccattgcccaggcttgcttaggtaaacaaagcagccaggaagctcgaactgggtggagttcaccacagctcaaggaggcctgcctgcctctgtaggctccacctctgggggcagggcacagacaaacaaaaagacagcagtaacctctgcagacttaaatgtccctgtctgatagctttgacgagagcagtggttctcccaacacgcagctggagatctgagaacgggcagactgcctcctcaagtgggtccctgacccctgacccctgagcagcctaactgggaggcaccacccagtaggggcagactgacacctcacatggccaggtactcctctgagacaaaacttccagaggaacgatcagacagcagcattcgcggttcacaaaaatccgctgttctgcagccaccactgctgatacccaggcaaacagggtctggagtggacctatggcaaactccaactgacctgcagctcagggtcctgtctgttagaaggaaaactaacaaacagaaaggacatccacaccaaaaacccatctgtacatcaccatcatcaaagaccaaaagtagataaaaccacaaagatggggaaaaaacggagcagaaaaactggaaactctaaaaagcagagcaactctcctcctccaaaggaacgcagttccccaccagcaatggaacaaagctggatggagaatgagtatgacgagttgagagaagaaggcttcagatgatcaaactacaccaagctacaggaggaaattcaaacgaaaggcaaagaagttaaaaactttgacaaaaatttagacgaatgtataactagaataaccaatacagagaagtgcttaaatgagctgatggagctgaaagccaaggctcaagaactacgtgaagaatgcagaagcctcaggagccaatgcgatcaactggaagaaagggtatcagtgatggaagatgaaatgaatgaaatgaagtgagaagggaagtttagagaaaaaacaataaaaagaaatgaataaagcctccaagaaatatgggactatgtgaaaagaccaaatctacgtctaattggtgtacctgaaagtgatggggagaatggaaccaagttggaaaacactctgcaggatattatccaggagaacttccccagtctagcaaggcaggccaacatacagattcaggaaatacagagaacgccacaaagatactcctcgagaagagcaactctaagacacataattgtcagattcaccaaagtggaaatgaaggaaaaaatgttaagggcagccagagagaaaggttgggttacccacaaagggaagcccatcagactaacagcggatctctcggcagaaactctgcaagccagaagagagtgggggccaatattcaacattcttaaagaaacgaattttcaatccagaatttcatatccagccacactaagcttcgtaagtgaaggagaaataaaatactttacagacaagcaaatgctgagagattttgtcaccaccaggcctgccctaaaagagctcctgaaggaagcactaaacatggaaaggaacaaccggtaccagctgctgccaaataatgccaaaatgtaaagaccatcgagactaggaagaaactgcaccaactaaaaagcaaaataaccagctaacatcataatgacaggatcaaattcacacataacaatattaactttaaatgtaaatggactaaatgctccaattaaaagacacagattggcaaattggataaagagtcaagacccatcagtgtgctatattcaggaaacccatctcacgcgcagagacacacataggctcaaaataaaaggatggaggaagatctaccaagcaaatggaaaacataaaaaggcaggggttgcaatcctagtctctgataaaacagacttgaaaccaacaaagatcaaaagagacaaagaaggccattacataatggtaaagggatcaattcaacaagaagagctaactatcctaaatatatatgcacccaatacaggagcacccacattcataaagcaagtcctgagtgacctacaaagagacttagactcccgcacaataataatgggagactttaacaccccactgtcaatattagacagatcaacgagacagaaagttaacaaggatatccaggaattgaactcagctctgcaccaagtggacctaatagacatctacagaactctccaccccaaatcaacagaatatacatttttttcagcaccacaccacacctattccaaaattgaccacatagtttgaagcaaagctctcctcagcaaatgtaaaagaacaaaaattttataacaaactgtctctcagaccacagtgcaatcaaactagaactcagcattaagaaactcactcaaaaccactcaactacatgcaaactgaacaacctgctcctgaatgactactgggtacataacgaaatgaaggcagaaataaagatgttctttgaaaccaacgagaacaaagacacaacataccagaatctctgggacacattcaaagcagtgtgtagagggaaatttatagcactaaatgcccacaagagaaagcaggaaaggtccaaaattgacaccctaacatcacaattaaaagaactagaaaagcaagagcaaacacattcaaaagctagcagaaggcaagaaataactaaaatcagagcagaactgaaggaaatagagacacaaaaaacccttcaaaacttaacgaatccaggagctggttttttgaaaggatcaacaaaattgataggccactagcaagactaataaagaagaaaagagaggagaatcaaatagacacaataaaaaatgataaaggggatatcaccaccgatcccacagaaatacaaactaccatcaaagaatactacaaacacctctacacaaataaactagaaaatctagaagaaagggataaattccttgacacatacactctcccaagactaaatcaggaagaaattgaatctctgaatagaccaatagcaggctctgaagttgtggcaataatcaatagcttatcaaccaaaaagagtccaggacaagatggattcacagccgaattctaccagaggtacaaggaggaactggtaccattccttctgatactatgccaatgaatagaaaaacagggaatcctccctaactcattttatgaggccagcatcatcctgataccaaagccaggcagagacacaaccaaaaaagataattttagaccaatatccttgatgaacattgatgcaaaaatcctcaataaaatactggcaaactgaatccagcagcacatcaaaaaccttatccaccacgatcaagtgggcttcatccctgggatgcaaggctggttcaatatatgcaaatcaataaatgtaatccagcatataaacagaaccaaaaaaaaaaacacatgattatctcaatagatgcagaaaaggcctttgacaaaattcaacaacccttcatgctaaaaactctcaataaattaggtattgatgggacatatctcaaaataataagagctatctatgacacacccacagccaatatcatgctgaatgggcgaaaactggaagcattccctttgaaaactggcacaagacagggatgccctctctcaccactcctattcaacatagtgttggaagttctggccagggcaatcaggcaggagaaagaaacaaagagcattcaattaggaaaagaggaagtcaaattgtctctgtttgcagatgacataattgtatatttagaaaaccccattgtctcagtccaaaatatccttaagctgataagctacttcagcatagtctcaggatacaaaatcaagatgcaaaaattacaagcattcctatacagcaataacagacaaacagagagccaaactatgagtgaactctcattcacaattgcttcaaagagaataaaatacctaggaatccaacttacaagggacatgaaggacctcttcaaggagaactacaaaccactgctcaatgaaataaaagaggatacaaagaaatggaagaacattccatgctcatgggtaggaagaatcaatatcatgaaaatggccatactgcccaaggtaatttgtagattgaatgccatccccatcaagctaccaatgactttcttcacagaattggaaaaaactactttaaagttcatacggaaccaaaaaagagcctgcatcgccaagtcaatcgtaagccaaaagaacaaagctggaggcatcacactatctgacttcaaactatactacaaggctacagtaaccaaaacagcatggtactggaaccaaaacagagatatagatcaatggaacagagcagagccctcagaaataatgccgcatatctacaactatctgatctttgacaaacctgagaaaaacaagcaatggggaaaggattccctatttaataaatggtgctgggaaaactggctagccatatgtagacagctgaaactggatcccttccttacaccttatacagaaattaattcaagatggattaaacacttaaacgttagacctaaaaccataaaaaccctagaagaaaacctaggcattaccattcaggacataggcatgggcaaggacttcatgtctaaaacaccaaaagcaatggcaacaaaagacaaaattgacaagtgggatctaattaaactcaagagcttctgcacagcaaaagaaactaccatcagagtgaacaggcaacctacaaaatgggagaaaattttcacaacctactcatctgacaaagggctaatatccagaatctacaatgaactcaaacaaatttacaagaaaaaacaaacaaccccatcaaaatggggggaaggatatgaacagacacttctcaaaagaagacatttatgcagccaaaagacacatgaaaaaatgctcatcatcactggccatcagagaaatgcaaatcaaaaccacaatgagataccatctcacacaagttagaatggcaatcattcaaaagtcaggaaacaacaggtgctggagaggatgtggagaaataggaacacttttacactgttggtgggactgtaaactagttcaaccattgtggaagtcagtgtggcgattcctcagggatctagaactggaaataccatttgacccagccatcccattactgggtatatacccaaaggactataaatcatgctgctataaagacacatgcacacgtatgtttattgcggcactattcacaatagcaaagacttggaaccaacccaaatgtccaacaatgatagactggattaagaaaatgtggcacatatacaccatggaatactatgcagccataaaaaatgatgagttcatgtcctttgtagggacatggatgaagttggaaatcatcattctcagtaaactatcacaaggacaaaaaaccaaacaccgcatattctcactcataggtgggaattgaacaatgagaacacatggacacaggaaggggaacatcacactctggggactgttgtggggtggggggagggggaaggatagcattaggagatataactaatgctaaatgaggagttaatgggtgcagcacacaagcatggcatatgtatgcatatgtaactaacctgcacattgtgcacatgtaccctaaaacttaaagtataataataataaaataaaataaaaaagaaaaataaaaagaaacttccatttaaaaggtaacttttgccaccggatctccaagtgttctatatcccctaatcaaaactcataatatcgtggaaatataaattgtagcataatgagtgttcaccaggtagagagaatgcatgtttctatattttgacatagacttgtggaaattagagaaatttttttcagctaacctacttaagaatcttatggtacatagacacctatatgtattttgtattgattttcttcctggatatatttatattgttaccatagtgttttgtttaattttgttgataaaaaccatgtgaaatgaagataactaatgaaaaaaaccaggtatgatcattttatctgcccatattagcaattttgaacattatttcaaagtgtcccagttgccttacaatccttaattatttggctaactgtatcattttattttgtgcgcactgaacagaagagaaaaagcatcaagttaatacaattatcctatcactgtaaaaattggtcccattttcttaaaaacaatttatttcttattttaacaaaataggagactatatttttgttttgttttgtttttgaatcgcagactgtaaattgaataagattaaaactttttttgtgacaaagtaatacaccttttattggatgccttgggaaaccaaactttttagtttagtttgttttctagaaaagcttctttagtgattcaaagtttgggaagcttgtctggtggccctacattaaggaaaggacatcaaaatccccaaagggaaccaaccttatcgtgagaagggagactctaggctggagacaccaagaacataaagttggggctcaagtatataggactattatatcaatcttagggagtaaattacttatggaagccctgaataacaatccatcaaatgaaacaaacgccattttgaatttgtgtagcaggaccataagcaaatagcacctgtgaaggaatgacattttctattttgttctctacttggagcatgggagaagaactgagctcttgggactgaataacttaacaattcttggacaaatagacagaggaggaagatatactagtatttatgttgctaatggtcagttgtgccttggtgtttacttagaaaagtaaatgatatacaactacatttaaatcctgggttcataaaactcactataatagtctattataccagatattctgtcatatctagctctgatttaattcagcaagtgtttattgaagatgtattatgtatcaggaattttaataatgctacaaaatccataatatattctgtcaatcagtttttcataggagaattctgttaatatgttcaaggttaagctaattcatgctaacataaacttctattataaagcaaaatttctgaaatgcttcataaatatttttaagtccaaataagatcaaatatattgtacatttctattctctgtgttctagactctttaaagtaccagctttgctatgctccattttttttgccttaataggtgcattagtttatcaaatacggttttatcgattattaaagagagatgcttcttctacccttacagaagacatagtgattatgctctcatgacataaaatcatttgggtaaagaagaaaaaatgtctcgttatccagatgttgagtttaaataatactaaacatctggtgttgtatgataaatttttcttcactctgaaaagctttaatttgagagaccgaagactcaaatgtcagccctaaaatatgtcatagcctaaaattaacacacaagtatttgtaatatgttggaggagttatttcaagaggtggctgacacagaaatgcataatctgatgctctgaacctcacccaaaagaatcatcctatgagtacacaagcagagagattttcacctaaacattttggcttttaagtttcctgtcatttatttgtccaatggcttctcttatccatatgcccagattctaagtgttaataactgtccaactctcaaaatacataatttatcatttattcagagtggttaggactggaaagtttgcaagttcttacacaaagaccacaaaaattaagtagcaaaggtatttttaaaataagatttgccatgtagtatgggatataatttacttactatgatgaaaataagaaatttttaaacagctaaacatatgattgaaaaccaagtgtttactataaacatacctgtcacaaattttacatacaaccatctacaattaattttttacttggtgtaaaagtcaaagtttaatttttccccatagtgtacctagcatcattgattggaaagaccatccttttctactgctagagagtgccacctttgtcacaaagccaatgttatatttgcgccagttctggactatttgatcctattggaagttttgtctacatttgcgttaccaccatactgtcttgcttaatttactttttaataatctcaccagcataacaaaagagggaaataggaattactgttatgaaagttagaaatcctttttcactcacattgtttagaattccagttcatgttgataaaaagtaaccaacatcttgtcatttttattataattttaaaaatctgtatagacagtttatctccttgtggcctgaagccagtgtggaccattatatcacccaccctcttcctgttcttgatagtctgtctataatttatttgttatctggtctaaacttcatacctttttttctctttttttttttgagagagtctctctgtcaccaagccttgagtgcagtggtgcaatctcggctcactgcaccctccacctctgggctcaaactatcctcccacctcagctcactagtagctggtactgcaggcgcaccaccatgccgggctaatttttgtattttttgtagagacggggtttcgccatgttgtccaggctggtcttgaactcctgggctcaagtgatccaccaaccttggcctctcaaagtgctgggattacaggtgtgagtctcagcaatttttaattccctgtaaatttcataattgatataaaaatgaaataaaagataatagcaacaacaaaactgcaattttcactggaattgcaatgaatctttagagcatcttgaaattaattggcaaagtctatagaaggagagttcatgcatgttggaatggcataagctatactcctttatactttgttttaatttatttttctcaataatgatctatatttttctgcatacacagcttgcatatctttcactacattattataaagtatttttgaactactccaaatggcattcctcatgacatgactaaattcatttattataaaaaattatccatagaagtgtttgaaatttccacctaggaaaccttaccatctgaggataattttgatggtacatttaaatatgaaaacaaatcaataaaacaccaagagacataaaatgttcatgattttgatgtaaggtgaccatttttaacaaaacacaaaaaaaatcacaaagggaacaattgatcaatagaactatgtattaattttttattgctgtgtaacaattactgcaaatttagtggcttaaaacaacacctgtttaccagctttcagtcttgtagatcagaaggccagaaatggcagagctaggttctctgcttagggtctcttaacattaaaaataaagtgtcagctgccctgtagtatcatctgggagtttctgatcccatatggtctgatatatttcagttccttgtggttgtgggaatgaggttctctttgagaggggccactcttaggttctagctctggtgacaacaaagggcagaaatttggggccatcttagaattctgcctaccacagctgtatttaaattagttacgttctttcattaatagaagacttttgcaatatatgtaaccataaataactcatgtttataaattataaggaacttctagaaatgaatgaggacgaacataaggaatatctgacagaatcttatcagtattgagaatctacagcattatgaagataagaaatcaagtgaaggaaatttttacagtatatatgtatatgaccataaagagatcctatttgtaagttatagggaacttagagaaatcaatgggaaaacatggagaaagtcatacaacatagagactcatatagatttaaataggcctttaataattttacttcatccaaatgaccattaaaacataaaaagtggattgtagttattacacagaatcagatagttgaaagtacagagtacgtccacataaagcttcactagacttaacagatgcagtgaagaaaataagtaatagcacaaatcagaaaggtctaagactttcaggtgcaggacttgggtcctttgactatttcatcgtgtatgccttatcttaggattattaaccacaaggttacaattttattgaggctctcttatatttcatcagtcatgtatctaaaagcatacgtgtaaccagataaaccaggtgcagaacatccatgtacgcatttttacagaacatcctatccacactggtgtccggtgcttctaggcagattctgatattgaactgcatagtataaatcactacctagtatatttcaccctgatcttggccagagattaataccgtagttccagacaccattggagaaaaagcctaaagttcccctcaactagctggaagttaacactctgtctgtattttgttcaatccccttactaatcagagaaaaaatgaaataaaacctcatttgcgtatccatagtccattaagtggattcaaatttaaagactgagaaggtgtacatattatgaccgaaatttctattcctgcatacatgcccagtagaaatgtatgtacatatacttcttacatgtaagcaataatagctgaaaattataaataacccagattccatcatagcagtatgtttaaataagtcgtggtattttcatatacttaattaccacctaacaatgaaaataaaccacacgacaggcaacaatatagtagaaactcccaaacataatattcggcatacgatgttaacttaaaagaatagatgaatctatttatacaaatttcaaaacaaggcaacaccaaactacagtgtttagggatgaatttgtagctgataaaataataagcataagcaactaagcggttaccatgaaaatcttttgaagagcagggagaaggtattgattagctggagaaatgaagtaggtttcccagtggagtctgtctggatgttcaatttgaaataatttattgagctgtgtgctatacttttgagcacttttctgttatgtgtttatcactcataattggaagatataaaatgttcaaaatattcagttgaatttcataaatatgtcatgattttatacaaattgagtttcagtttacctctaaataaaacaaagtgataatatttaatacatacataattagagagatggtcacatgaaattacattacttatcaattgtgacatcagaagtgtgaattttaatacatagttatccccataaaagaagtcagcaggccaggcgctgtggctcacgcctataagtccagcactttgggaggccgaggcgggcggatcacgaggtcaggagatcgagaccatcccggcgaacacggtgaaaccacatctctactaaaaaaataaaaaaaaaatagccaggcgtggtggcgggtgcctgtagtcccagctactcgggaggctgaggcaggagaatggcgtgaacccgggaggcggagcttgcagtgagctgagatcgcgccactgccctcctgcctgggcaacagagcaagactccatctcaaaaaaaaaaaaaaaaaaagaaaaagaaaaaagaaaaaaaagaagtcagcagtttggggtaataaaaactattcatctaatgatttttttttttttttttctgagacagagtcttgctctgttgcccaggctggagtgcagtggcatgatctcagttcactgcaacctttgcctcccaggttcatgtgattctgctgcctcagtctcccaagtagctgggattacaggtgtccaccaccacgcccagctaattttttgtatttttagtagagatgggatttcactatgttgaccaggctagtcttgaactcctgttctcaagtgatccgcccacctcggcatcccaaagtgcagggattacaggcctgaaccatgctacccagaccatattacgattttttaactgaaatctgcagagattatacgacaaggtgctgcaacacttgtcaatattctacttgcttagctttactttactttttcaaattgtttcacccttaacattaagagtatctcctttgttcccagaatttatgagatttttcaccacctgaaatagtgtttgacaggcattttccatctgtctgctttgaactacacctctctctccgcatcatcccatttgggctgacaacacactgttgattagtcttctgatgcctaggacatcacttcatcactgcactttctactcagagtaaatcattaagtatttttatagtgttagtttgaaagttgaataatcatttttaaaaagcaatttggaacacctttgctgtttggatgcctttgatgtctactaatggatgttatttttctgtcaaattttgcataacatttttaacggaaatatataaattttttatatgagaacaatttggaaagtttataacttttattctgaagtcttggtgcataaagagaaaaaatccactttgatctgcttcctcagattaaagtattaataaaaccaagagagcaagtttaaactttctttataagttggttcctttttgtctataacattacaaagatgtaattttgtgcagtagggggaattggaaagctgaaaagggctgaaggtctttgagtggtcaagaagtaatgattctgtcacagccaaaagaacagtgagatgagagaaacaaaacaatcattgtcaaatttaagaatgtttatttttttctcttccccaaactgccaacaaggaaagtattattctttctccagaaacgaaccctcctaactatactttaattttaaagtccaaagtttgcaacaaatttaaattagccccaccaagatcactctctattatttccttcataatatctatcactaactataattatccagcttatttaattgcaaataattacaaaccaatgttgattatttgcctcttcagctagaatattgtctgaactcctggtctcgtttttcgcctattctcttcactcattaaaacgcaacttctcactacaaccccaatgacactgctatagctaagatcaaaacaaccccaagttttcaatccaggggccatttctctttcaatatcttaaaggctgctcagcagcattctgaattttcaaacacaacctccccttccatctttgccccaaggccccatttaaatcatttcttctctcctattctaggatcagaggtgtttctggttttcctccacttccctggccactgctttaaagttcctttgttaaatcatctttctgtacttgaactttaaaagctgagtgcctgggaaccccagtctagccctgctctctcttcccttctgcaagccctctctagaagctctcttccctctcttcccttctgcgagccctctctagaagctctaggttaatctgtggagagacctgtatgacctttccatgtgagtgtggaaaaaaaatctcaaattttacgcattaaaaatggaaattttgttcctttttctatgccccaaatatattgtcactgttctgtttggtgttcaggaacatatctataggtcccaaattactttagataccaacaaatttttcttctcacaaaataaaaataagggtcaggtacagtggctcatgcctgtaatcccaacgctttggaagactgaggcgggaggattgcttgaactcaggagcttgagaccaaacagggcaacatagggagaccctatttctacccaaaaaaaaaaaaaaaaaagcaggacacggtatcacacatctataatctcagcttctcaggaggctgaggtgggaggatcacttgagcccaggaatttgaggcttcagtgagctaggatcacactgctgcactctagcctgggtggagtgagatgctatctctaaattagttaattaattaattaaagacaatcattcctcagcaaaaatatgatgaatggcacttaccacttgtattaagatgattgtttgtttgctctgaagaagggtgaacacagataattaattcagtaatcaaatgaatttataccagaccaaatagaatcccttatatatatattttttaaaaatgcttttttttttgtactgtgtcttggatgaattcctgaaattatgcactagtgccctacttctctgatcatgtgtggcttagagtttattgtctctatcgaggtcattcaactctttttaggatatattttttatttcaaggttttctaattaattatttttatatccatttttccttgcttcatttctgcctgtttttactcatttaataatttcttttcctttttataaatgctgtttttcacttacattttgaaaattctaagcatgcattttttacaatcactttactgttttctttacgtatcagtagatgtatctcctgattgttgatttccttgcctaacttttgaagttttgctcacatattttagaattttggtttgcacacttgagtaaactttctctctgcttcggtgatgatttttttctgttcttcctctgaatgaccccgtagggggggcatttgcaatctgcatttgcagtcttcctactacctttggcaatattgtagaaccaagagttaagggaactctctagcctggatgaagtccacaacctgctgtctcccgaattcctaggaaaacagatttatagaagccctagttacaggtacagctcagcagctcagcagtagcacttttcagcctcttttcaagggcagagggacttgacaataaatctttacttcaggcagcctgtctggctcctgttgtatatgtcatattggttgatttaagtactcactgtccttcaaggagatgaaactccagtccatctttgcaagcttgtattctcagatcaagtcagcagatctaatttcacatcgttttttgtttgtttctgttatgcttattattgtccatgaactttttcttttatttcttggctgcacctttttattcagcttatcattgctgtatatctgaagcagaggaaaaactcaaaagtatgaacttatgatgccatctagactaagaattttcttggtattgaagttgtatgcaaaaagatgacaggactggtttttgtctttactttttacactgaatttataataatttcttaaatagatttcacagtgttttggacctagtgcctgtgtgttgagaagcctcatcttttgttaatactgaacattaactcacaactcacaattttttcttctaccaaatatgccttttttatttctttatgcaaaacatgtggaatggtaaagctaattattagaggatgaccgtcaggaaacaataaatagttgtcaacctgcattatttgttatgttaatatttctactctaaaaatatttctcaccaagtcttataagttccacattagatgttttatatagtttaacatgtcattcttctttaactcaaaatactaaaaaatgaccttaaagtgactccatttatgttgcctggttttgtttatttgaatagcctcaggattagtgcacactggagattttgacaggtttaattattctacacatttaactggtgagaatttaattactctagtgttcccagagagctgatgacacaggtgagatcttaaaaaataataaataaacaaagataggtataatgtgtgtctctaccaatttatagttaggaatattttacacttcataggatataccttatttaaacctccatttaacaattctgaaattttagtgttttctaggttaattagcatctaaaattaattgaatataatatcaaatatatattattttatttgcattatatacttatgtaacatataacagaaatacataatatatatagatatttctaaggttttcattttgaaatagttttggatttgacagtaaatttggaagaacagtacaaatacttttcatgtgttcttcccttcagttagagatatcacaaattttatgaaatatttgaaactaagttactaatgtgatgtcctttagttttaaattcttcattgagtgttttctaaaagctaggacttttttgtagggggtggggggcttaactacagtgcaatgatcaaaattagaaaattcacagcggtggctcacacctgtaatcccagcactttgggaggccgagacgggcggatcacgaggtcaggagatcgagaccatcctggctaacacggtgaaaccccgtctctactaaaaatacaaaaattagccgggcatggtggcgcgtgcctgtagtcccagctacacgggaggctgaggcaggagaatggcgtgaacccgggaggcggagcttgcagtgagctgagatcgcgccactgcactccagcctgggcgacagagcgaaactccgtctcaaaaaaaaaaaaaaaaaaaaaaagaaaattcacagaagtagaatcctattatctgcattcattgtataagttgtatcaattattcaactaacatttattataacaaatacggtaaaacaatgtctttcctggtccagggtctaaaccagcaccatatgtggcacacacctcactcatgtcctttaatgtggaacaattccacagtctctgtttgtcttttatgactttgacattttttttcgtgtaagggaacaggcttattattttgttgaatgaccttgacttggctttcatgatattttctaatgattacattatgcattttgggcaggaataccatcaaattactgttgtgcccttcacagtaaattatagcacctggatatcatacttattttttctctgtaccggtgaggttaactttgatcatttgcttttcttcactttaaagtttccactttctctttgtaattaatttgtaataaactggggagctattttaagaccatgtcaaatatctaatttcttgtcaaaattgtattcgctgtattagcatccaggtaatttttgcctgaaactgtcattactatgatgccacctggtgattttccagttttatcattcatcctacacttgttagttggtattctagcatgaagaaaacttttcagtactgtcccatttaattatgtaagcatgtatttaattaggtatgtatgaattcatggttccttattttattcaatggctcataatccataaatataattagtattaccaatgcttacactgttttagatttggcctctggaaatccctcaaaggttgctcatatgtcctttgaattgtcaccattattctttacatggtcctttactttttgaaaagcacaaaaagatgattcagatcaactgtattaagaattgggtatttctgcaagaagctctccttcttttgtgtggaaaataaatttagaaaccaaaatatggacactaggtgtccttactcataatggaatgtctttgcttctaggtccttttatcagacagttatgaactgcaaatatgcatacgtagacttttcctgtctctttacagcttcaagatcctccattgtatggatatgtcagagttcattcagtcctacatatgggcatttagctttttttcaactttttgcaattacaaactgtattgtaatgattcgctttgtacatatgttttttaatgtctgccataatggtaatttctagaattgaaattgctgctaaaaaggtaaaatatatgtaatatgttagatattgccaagaaggatgtatcaatttgctttttcacagaaacatcttagtgctggtttcccactgcgtctccaatagcatgtgtcctcatactcatttaaacttttgccgttctcttaggtgataaatggcatgtcacgcagctttaatttccacttctctaattctgaacatatttcatatttcatatgttcagtaaagctgaacatattttgctaagtttaagagccattcatatatatttgttgtgaattttctgtgatttttggcccatttttctataagatcttaaattttttaatattagggatattagttgtttatctgtaatagacttttcattttttttccaactgtcagttgtcttttgatagtatttatagtgcttgttatccgataaattttttttacggaaaattcatcaatattatattttctttttctttttctttttttttttttgagatggagtctcgctttgttgctcaggctggagtgcagtgtcatgagctaggctcactgcaacctccacctcccaggttcaagcgattctcccgcctcagcctcccgaatagctgggattacaggtgcccaccactatgcccagctaatttttatatttttagtaaagatggggtttcaccatgttggccaggctggtctcgaactcatggcctcaagtgatccgcctgcctcagcctcccaaagtgctgggattacaggcatgagccaccatgcccaacctgtattttgtttttccttttgttttttaagtctgaattctgagtcatagttaaaaacaaaacaaaactttttctgctttcatgctgcagagaaatacatccatatgttattatggttgttgtaaatattttccttattgtttgtttccgtgtttgcttacatttaaattttggtttcactttgaatttattcttttgcacattatgatatttggatctaatagtacatgtttttcaagtggtcaactagttgtcccggaactatttgttggagtttgtctttgatctgaatatttagatgctatttgtatcagatatccaatttcatatgtaggtttatttctagacagcctttgtggatttgtacagttgcctacttacatgcccatactccactgttttaaaataaagatttttatatattaaaacatcataggttgccaatcattccttacagttttctttttcattgatttcttaacagttttgcatgcttcttcccctgtgaacttcattattaacttctcttgctcctcacaagcattttttggtatttttattgtgatgacattacatttataactttccttataaaagctgacctatttatgatgttgagtcattctaaacactaatagaagtttaatagaagtttttttctattttttattctcctttatggtggttcaagagaaatgcacatactttaaaggcttagaaaatgaggttataattaacatcggcacctattttattgatgcaatctaatttctaggtttttttaaaatttctcttttcaaatatgttgtatgagctatgtcaagcacttatctaagataccaacagctaacctttcctgattttcccactttgtaataagtgagagattatttgcttcatgtgtagtaatttttctctctattccagtgctttatgtatttgttgccatatctatattttacagctctcatacctgttaaagagtaagttcaatgaaattgtagtttccctctttttcatgtattttaagttacataaattaaaagagatgtttatgctagaatgtttatgtgtagatttgacaatggtgccaaatttacacaggtaaaatgcacaaaactgatatttcagacataggcttgaactaatcacctaaattatatatagtatattattttttgtgccatacattagagcctatatacaagatatataaaaaggactacttaattatatatttttaattgctgttagagcattaaatctatttttattttaaatgtatgtagtcattttttgttatttaaagaagtatagctatggaaataagaaatgtaagttatatagtaggaaatattattggaaaacattaatgattatacaaataatcagataattattttctagcatagtaatataattttcaaatttactgtaaatttgaaaaatgtttacactgaatccctatgtgcttaaaacctggtcttctactaacattatattataattgtttatcacatttcaacagatacacctttttctctatccacccatcaagctgtcttatttatgatgcctttcaaagtaaattggaagcatcactgcaccttcccctaaatacttcagcatccgtgtcattaaccaaggttcaatattttgttataatttactcaaatgaaataaaacaaattttaattgtctattcactaggttctgaaaaaatacctgtccttagtaatccttacctctaccaatatataaaacaatacaaccaactcaaatcatttccctatgtgtgtttctagaaaatcccctcaccccactctcaagacaagcacctgacttttttccaaaatagaataatttcatggtcataaaagtttacatgcatggaatcatatcgcatgtgctctttagtgtaaggtttctttccattattgtattgttttttggtattaatcagagttgcatgcatcagtaatttttctttatctctgcgtagcattcaattgttaaatacactaatgttttctcggtgatattggagtagtttccagttttaaattattataaagtggctattaatattcttgtacaggtttttgcgaacatttttcatttatcttaagtacatgtctaggaatgtcatcactacattacggagaaagttaatatttagtttataggaaactgacaaactgtttctccagtgatgataccatttcaaatttccaccaacaatttatgagagttgtaattgctcaacacacttgtcaacactgttttgtcagtcttttcttatttttagtcattttggtggatgtgttgtggtatttcattagtagttttaatttatatttctataatgatgaataatttgagcactttctaaccgtgtaatggtaacttgcatatcttcattttgaagtgtctaggtactttgtcttttattatttctcataggagatatatgtacattttctatgtgagccctttgtcacatacataggttatgagtgttttctgttggctaatgctcacctaagtattttttaaagatgcctctgctgtggttcgaatgtatgggttcctccaacatttataagctggaacctaatatccaatgtaatagtcttaagaggtggggacttttgggaattgattaagtcatgagctctcctctcacatgaatgaaattactgctcttataaaagaggccgaagggaacactatcgtttctttttgttcttccatcttttctgccatgtgagaacacacagttcatcacctctagtggacacagccacaaagtgccatcttggaagcagagagttagtcataacgagacactgaatctgttgacatcttgatcttggtattcctagcctccagaactttgataaatacattttaaatctctttttgatactatgtcaatgccacagttttgattatactggatttatagtagccatgaattcaaacaacatgcattcaatttttgttcttattttctaaaatttcagaggtattcgaggtctttggtgtttacatatacattttagaatcatcttgtcaatttactttattaaaataagcttttgagagggattttagtggggataactgtaaatgtatggatcaattggggaataattaaaatctagatactactgactcatctagtccatgaatactgtatacatatttatttaaaatttttcttagcaatatcatatcatttctagaattagtaaggatacaactaaaacatttgattattactttatgtttctacttcagaaaatgacactcaatatcactttacaatgttatgtgatgaagatattattatatttaaaaacatctacactgataggagttatggagagttaatacttaagttcaaggtttaggtaaccttgacgatatacaaatttgcagcctcttataagaccttgtacattgatcttgactcgtgttcagttgcctgattatgaatgaccttttgatgagcgatctagggcaaattactttgtctctctgtaattccgttttctcagctctaaatgggtgaaacagtggtggggttgcaaggctttacagacagaatagaagcaaggtcttagaacagtgtttgaacactgaaaagcaccataatgatcaactgttttccttttcattcatgaccttttcttccctttccttctgcatgccaagcccttccctgctttagagtctttgcgttccctttgcctattttctcagctcctctgagggagacttcctttttatctttcactcatagcttgaatgttctttctcttgaagaagattcccaatcatttaatatgaagagaagctctctgttctctatctcaacaatatgtttattatctttatggcaatcaaaaggctttcaaaaagtgctcttgttttgttttacattactttgcatatttgtttttgatattcaatgtagaaattaggcactgtgcctcctatgtttaccaatatatgttaatagcatggtacagtgcctttctaatgtagatacttagctaatatttatcaaatacatgaatcttcaatgaggcagaatagccctggctatactctaaatgtttgtgtccccctaaaatatatatattgcaaactagttcccagtgtagtgttattagaaagtagaacatttgggagatgattaggtcattagtgtgtcacccacataaataggatgagggcccttataaaagaggcctgaaggagctctgtcatccttccatgtgagacacagcaaaaaggcaccatctatgacacagagaaggagcactgaccagacactgaatgagtcggcaccttgatcttggacttcccagcctccagaactgtgagaaataaatttctgttgtttatgaattatgcactttgtcgtactttgttatagcagcctgaatgaactcagaaatactttattactgagaagtggggtgctgatgtaacagatacctaaaaatgtggaggcagctttgggaatgggtaatgggtggagacggaaagaattttcaggtgtgtactagaaaaagcctacattgctgtgacaggagcattaaggactgttttggtgggggctcagaaaaagaggagagctgcagaaaaccgcagtcttcacagagattacatacattgttatgaacagaatattggtagaaatatggatggcaaagaccattctgattaagtcaaataaaaatgagaaacatgcttttttttggaaattggaggaaaggtgattcttgtaataaaatggcaaggaagttggctgaattttggtcatggcctagtgttttgtggaaggctgaacttgtgagcaatgaatttaggatatttggtggaagaaacatagcaaagtgttgagggtgtggcatgccttttgtttactatttatagtaaaatatgagaagggagaaatgacctaaagatagagtttctagtccaaagcataggacaatgtaaagatttggagtattctaagcctggtcatgttgtgaagaataaagacacttgtttgggagagaacaacaggggtgcagcaaagtgactgataaggacattgccatggatttgcggaagccaggtgctatttatcaagacaatagaaaatgactgcaaaagtgtctcagggatcagcagggctgccaccctcatcaaacacccagagtgccagtacctgagggacagaactatgtcaaaatgggggtgtcaggcatttgtcagatctcaatgctcattgttctgccactgcctcaagtctctgctccctaaattttggtatagggatcctcagctgtcccaggtgtggctccagtggccccacaggccacagcgaccacctttcaggagacacaggcagtaaaccttggaagtacccatgtgagccatctccaccagccagcagaattcagggttgtggggcatggctgcctacatcatgatctcagtggatgtcccagagcatcgcaaggcccaggcagagaactgctgcaggggtgaggcaccacagagagcctccactagggcaatgcttagtaaagctatggagacagggccacctctgtgatccccggctggttgaatcacagacattcagttccagtccagaaaacccagagagcatgaccgcaacctgtgagagctgtggtatgaactgcacccagaaaagttatgagacagggctttctggagccttgggagcccacccccaaccccagtgtgtccagaaggctggacatggaaactattatcaagattactctggatacttaagatttaatgtcattttccctgctgaattttggactcggttggagcttgtcacttcttccttctttcctatttctcccttttggaatgggaagatttatcctatgcctgtgcaaccattgtattttggaacctcacgactcacaggctcacaactagagaaaaatttgcctcggaataaatctaaccttgagtctcactgatgtctgatttagataatatttagataagtctttggatttaggctttaaagttgatgctgggactagttaagatgttggatgcttttgggatggaatgagtgtattttccacatgagaaggatgtggattttgagtggacaggggtggaatactacagtatggttatttgttttttctccccaaaatttatatattgcaacctaatacccaatttagtagtattaagagacaggacctttggtaggtgattagatcatgagggctccaccctcatgaatggaattcttgaccttataaaagaggcctgagggagcttgttcacccttccaatatgtgagcacacaacaagaagttgccatctatgaagcagagaggtttccccagacatggaacctgctggtaccttgatcttggacttcccagtctccagaaagatgagcaagaaatctcttttatttataaattgcctggtttaagacattttgttggctgggcgcggtggctcacacctgtaatcccagcactttggaaggcctaggcgggcggatcaggaggtcagcagatcaatacgatcctggctaacacagtgaaaccctgtctctactaaaaatacaaaaaattagccgggggtggtggtgggcgcctgtagtcccagctactcgggaggctgaggcaggacaatggcgtgaacccgggatgggaagcttgcagtgagccaagatcgtgccactctactccagcctgggcgacagagcgagactccatctcaaaaaagaaaaaaaaaaaaaaaagatattttgttatagcagcctaaatggactaagatagctctcattttagaaattttgataatggttcttaagtagaaattttgtcttttcaaattcactgcaaagtaccatctgtgagttcttattttgaaatattgccaacattcaagataataataataatatatatatatatggctattcttattcttcccagtaacttgaaattaagacgtgtggagaggattttcaaggtgcagttattgtcaacaaaagtgtcctcttgtctccagaattaactattcaaacacagttcttacaaaattgttgtttttgtttcaaacaaatagtgctcacagtacttattatttattaatttagcaaacactgacttttttctagattcttagcattcttctgagagaaaacatgactgaacaagacagagctcatgttacagagtgttaaaggagcacaagtttttttaaaagaatattgaagaggacctgagcaaagacttgaaggaggtgacctctctcttcaatttcattttctgccctttttctttaaagacttaccatatgccctggccacataggattactctaagtcttatacattctatatttttccacctctgttttcttgttttcatattttcatatttttcctccacctagaataggttttctttgtttttatgtctctgccaccatcctggttatagctactattacagctgctgttactttttactggtttccacaatatcctttcatcccatacagtaggtcctcacttaacaccatccgtaagttcttggaaactgctactgtaagtgaaacaacatgtaataaaaccaattttcttatagactaatataaacaagagttctgtttgtaaatatatttctggtcacaaaagtgtcaccaaattctacataaagacccaaacatttctattagtaaaaattggaataaatgtaagctatacatacatttaagaaagattaatcaaaacaagtaagataattatttaccaactttcggtgatggtgagtgactgtggtcataatggaatttaatcaaggaatacacgtttgtgaagccaaacttgtaaggagcaacctcccctcaccacaaagttcaaaagcaatcataaagagggtgagctcactgagtgctttcctactacaccgtttattgccacgcatctgtatgattgttgtctacttggtgaatttctagtttacaatcatttgtattttttcattcgctcatttttcaacctgcttatttcagttcagggttgcaggtggccgcagcctgtcctgacagctcaaggagccaggcgggaccaccccagccagccaccctcccgtcgcctggtgactcatgttcacccacaaacactcacactcgcccacactcattcatccacattcactcacactcacctacattcactctttcatccacactcaccctcactcacccactcacattcacccaaactcactcacactcacccactcacactcatctacactcacattcatccacactcagtcactcttaccctcactcacccactcacactcacccaaactcactcacactcactcacactcatccacagtcacactcaccctcatccactcacactcacccaaactcacactcacccacactcacctatactcacattcatccacattcactgacactcacctacactcatccacactcagtcacacccacactcacacccacacacaccttcactcacacttactcacaatcacactcaaccacactcacattaatccaccttcattcattcacctacactcatccagacttacactcacctacactcattcactctcacacacacacatacccccactcacacccccactcacatcctcaaacacaaattcacccacattcgtcctcactcactcatactcatacccacactcacactcatactcaccctcattcaccctcacccacactcaccctcaccctcactcacccacattcacccacaccactcatatccacactgggatacggggaactgctagggaacttaatgggcacagctttgggatatgggcggaaaccttagtgctcagggaaaacctaggcagagagaacatgcagactccacacagacaagggctcagacaggaacgagacaggtggtagggctcgacttcagagacaaggtttggccaccagaccaaatggaggactatttaaaacagcgacagggcagaagcacctcctcataagacacacccaccagtgtgccattgtcagtttacctctgccatagcaacatctggaagttactgcccctttccatggcaacaatgcaacgagtcagaagttaccacccttttcctagaaatttctgcataatccaccccttcatttgcatgtaactaaaaatgagtataattatgacttcaaaacttcctctgagctgctgctgctgctctgggcacactgcctatggggtagccccactctgctggggcagtacctccactgctgctggggcagtacctccacggctgctgtacactgcgcttcagtaagagttgctatttcacatcacctgctggcccttgaatgccttcctgagcgaagccaagaaccctcccaggctcgactgtcctgcatcagaagcaaatgttttccttatccatgtaataaggaaacaacgtggaagaaaaggctgttctgcaggacctgctccgctctccgcaggcgttactgaccagttagtcaggactatacttccaaccgatcacttcgttatgatcataaaagacaaaataatgcctcagcccacaggccctgtgcgatgtgccagtgaccaccccctggcggcactcatcatctgccatgtgccacctgttactactctgtccatcattccatggtctttccggcttcagagccagagcatgaactacccctctgcctagactcccctctcacccgtgcggggcatttctgacataacgcccgctcatgctgcaaacacaacaacaattcacttccttaagcagctccccgcttgccatcctcccctacctgtccttagccaatattctattacatgagtacagaacaccccgaatctcccctttttctaaaactatattaaagtcctgcttcggctgggcacagtggctcatgcctgtaatctcaccattttgggaggccaaggcaggagcatcacctgaggtcaggagtttgagatcagcctggccaacatggtaaaaccccatctccactaaaaatacaaaaaaaattagctgggcgtggtggcacacgcctgtagtccgagctacttggaaggctgaggcaggaaaatcacttgaacctgggaggcagaggttgtagtgagccgagattgcaccactgcactccagcctgggtgacagagcaagatcctgtctcaaaattaataaataaaatttaaaagtcctgcttcttcagttactctatgtttgctttaccttctgttataaagaagacaggactgttttttttttttcttttcttagtgagtgctgcaatttacctccttggtaaatcttttcatagagtagatttttaataaatgtttgttgatgaatggtctattttttatttattaaaatgactatttagaaagataaaagaaatgcccgcaagttaaacagttttaaaagctgacaaccgccaaacaacacaaaatacagaaaaatagtatatctattgcctgccagacacactgcttaacacatttcccccctacattttgtgtactctgattgcctctgcaaatgacaattttgtatttttctacagagagaaaagaaaattaatgtactctttcttcttgcatagtgtattaaaatgtgttctttttttaaatgatagctggggcacataaaacatgtgatttcacacacaaatgtgcttatttctatcagtttgagtatttaaatgtgggattttggtagattttattgacatgatgagacagccaggtaggaggggggtccctggaggaactccaaccagcctgaccactgaagtggagcctcttgagaaattcctgatgtttgcagcagggagggacctggcccctcctcctcctgtgtggaaactgggattccaactgcagggtaggaagtgctctagcagggactccggccttgcaagagtccctgtttccccttttcacccaataaaaccctgtttcactcacccttcaaaccatctgcgaacctacattttcatggctgtggaacgaacaaggaccctgtctttagctgaactaaggaaaagtcctgcaacaatgatacaccttaaaggcatatggtccatttactgtataaatcttgcattattatacatatttctgacatgagaatattgtccttttgactctgttttcaatttcaggtggttgataattggtggtgttttccacacactgtcttcttacgttgaatgtctcaaacataggcttgtctttcatcctcaaacttggaattctggatgccacaggacatgattatatagtaatgtggcccctactcttgcaactgtgtgtcttgaggcttgcaagtcagcatagtggtgataggagtgctttggaaaaccattcctctctctggctctgataactgctaggaactaaattacacactggagtgatctgagaccccatggatatcccaaaaaccccaaactaaatttgttctcaatgcaatttcctcttagataaatcctaaaattgccgtcttgccattccagtgctctcttggaggaagggaagacggagtagaaggaaataacactcataacagattttgattaaaatatctttcctttaaacacatggccacgtgagcacatcatgaggatgcttcactggacttatgaaagagcctcttttggaggtgaaagttactgaacttaagcaattgtaagctttatggtaaatccatttctgtaattaattatttgggatatattttctgctatgtcactcaaatattaaaaaaccagaccaaggttttgtgatttaaaattgtcttttaggaagggcagaatgtatgatgtcagttttgtcttgttttgtcttgttttctggagacccagaggtgggggagaattagtactttttaatttcagattattttgatcatttgcttttctataagttgttcttctcaacctctcttcacttttttactgctttcctcttttgtcctttctttttaccaagataaagtgattggttttatgactgtagctaccagtccaagttaccaggcccatacagtatcgtggattatttcggaaggagggtccccaatcttctattatgaaaccaagtgatgtttctggggcgatacctgcagataagactggacaagtaagaggaagcattttcaggggataaaaaatggctggtttagttcaatgaagggaatttatgatagccttccaatggagatttgctgttatcttcacagcctcgcagctatgccagctgaagtcactatgtttcaaataccaggagcaggataaccccgtgtttacagctctcgacatcagtcttttctttccttccagtctttcctttcattctttcctttcttttctcccttcctttaatttctctttttctttttcatatatttttattgttattgtttaatatttttgcatctatagatcaacctctaactttatattcttatcatatgtttgtcatgtttttaattttttaaaatttggtttgctagtctaccttagcaagttaggaaatgttcctcatttgtgcattttgtaaaatataaaggatgggttttttaaatataaagttctgtataccttgcacaagcatataataggggctcaataaataattattgatttggtaacttgccaacaacctcagctttcttcagttattttatcctctctaactttatgcctttatattagtgtcatctttttagctctaatttcacagctgctataatagcttccaggaagaaatttcctaatcactttgacaatgaagtctaagtgattagacttggtttgatggtatgatttggcatgttttcttctccatagactttttgagttttgtcaggaaaaaaggaatattgtcccaatgtataattccagggactatatgtaatccatgggggagaatttgtgtctatgcgtgtgtgtgtgtgtgtgtgtgtgtgtgcgtgtgcatgtaaaggaatgggtttttgattattgaactttctgatactcatcccacaatggtggcccgtgtgggaagtggtaaatgacactattgcttcatgagcctggccctaactattgctacatacataaccatgaatcctaaggtgcgatgaaaaccagggctagatggggtataagtatggctgccctttcttgtgctacaaacagctcttttctacttgaaccttcgtgagactgccagaaggtgagacagaaaatatggaagagatatacgtgatttggagttcccccaaaactccaacattagtgctatcatttaagtcagtaaactgggagaggcagactcatcctcagactgggtgggcaccatcgaatcagctgccactgcagcttggataaaggcaggcagaggagtggggaaggactggactggctgagtcttctggcctccatctttttcctgtgctggatgcttcctgccctggaacatcgcacttcaagttcttcagctttgggactcttggaccttccaccacagactgaaggctgcactgccgtcttctctacttttgaggttttgggactcgaactggcttccttgctcctcagcctgcagaggacctattgtgggacctcaccttgtgaccctgtgagtcaatactccttaataaactctcctttatatatacatccatcctattagttctgtccctctggaaatccctgactaataaatctttcttacttttttttttcttttgaatttcctccccttttagggtcggggttttgatctgtttgattaaacattacttgaaacttttagttatgtgctctgcaattatgtgcctagttaggcatgctattgacatttttatatattccacacaggaaatcctctgcagtaatgtagcttttcattctggttacaattattagacatacaaatttctgcttaaacttcattgtatcctcacaatctctgggataaagacaaattagcagctctccttacagaatgaaaacagaacatgctaatttattctgtttaaatttttcatgaaacgcatcaatgaattcaacatcagcttgtcagttgaacctgtttcccccttttatctcagatagccacataatttattttggaaggtatctgctttgttgtttctatctcactgaactctcatttcctggattctctgccatatggtagtacttttttataaagttccagttcaaaaatgccacacataaccaaaaaaatacacaaaagagaaattcaatgacagtcaatgattcctagtcacatagactagaatcagctttcaaggaaggtgacatggcaagaatattacttgtaagaacaagggactctgatctatatcaccgttattcaccccaactcttgtaaagatgtcattaaaatatttcttgtgttaaacattccaatatgctattaaaataaggtcatttatcctcaaagatctgtgataagacagtctttctcattcttaataattttatctagattacatatttgctattaaacctatccttacttttggtaacagtataatgaatcataataagagttatattaggccagttgcgttggcttatgcctgtaatcccagcactttgggaggttgaggggagcagatcacctgaggtcagtagttccagactagcctggccaacatggtgaaaccctgtctctactacaaatacaagaaattagccaggtatggtggtgcatacctgtaatcccagctactcgggaggctgaggcagaagaatcgcttgaatccaggagacggaggttgcagtgagccgagattgcgccactgcactccaggggggtgacagagagagactctgtcgcagaaaataaataaacaaataaataaaaattatgttattacatcatcagacttttaaaaaatcattgagcgatgaattgagtaacatataatagggataaatatgaattttaaatcctaacccataggtacattgtcttagaaaagttaaactgcttttacatgaagtaactactactactaataccaaagtgatgaactttataatccaggcatctttatatgttatacttgtatgtttaatagacaaattatttgtatagtgtgagaaaggttaaaacaatactgatttgaaactgagtaaaccattaagaatgaattatttccatttatacttataaagaaagatacattaaaaattttcatgctgaaatgatattaaaataattatatttatttttaagataatatttgatgattaggacaaagtttcagcgtaagaacttaaggatagaattaagaagatttatcaaatgtacttttagtacttttgtgctatttctttcaaaatcttcagttcattggatacttacctccatagaaagattacttaatatttgtagcatattatgtgattttgtcttagactcaaagaaatctcattattgtgtaaattctctaggcttctaatataatatcagagtctgggatacgtcgttcaaccttaagagaatatagctatataagccataaccacttaatggatttcttcagttataataataaccaatttctatataattctttagattagacataatggtattcacgcatatccgtatatctaaaacaattatttcaaatgagtactattgaaataaaataacataggctaatgaaatacccacccctccctcaaattgatacagcttcataatcagaatcaaaatagtatcaaatggatactgtttccaattcgtagcttcagaatgataaattacaatgttttctgagcatatgctcaacatagattttaaaacacaaaatctactgtagctgttgaaaatttagcagataaaatcttatgcgtttcagaagtatggatgaaaataagaacaatgaaatcacaattattttctttaaaaatataagtgttgctttaggtggaaaaatgtttttgcctaaattaagaagtgttacattcaattatgacctgtgaaagtaaagctgctttctctaataatacagaattttcttcatttctttgtgtaataataaatattttgaggtattatgattatcttgggaaatgcttatgtcaaattttattaattcactgtagggatctatacttaatcttttactgtaattacggtaggaatatctctctttttagctccttaatcttttactgtaattacggtagaaatatctatttttagctctacttcaggggttgtccttctggaaaaaaatgaacttctttaaaggaatactttgctagtaatttttttccagtttctttctaaagtaaatcacttcaacttttaaaattatcactttatgtttgaaatgttatttgttttccaaggcatcaaaaggcatccaataagcaactgcattaaaatttgttttacatatttggattgcattccatctaaagatatttttaattgcagtgaaatccagcaattttttatgttttacataatatttaatgttgttaaaatatattttatgatcttttaaatctcattattttattacagtcatttctttcttaatagtaattaatataattatgaccattgctgatatgctttggctgtgtcccctccaaaatctctttgaattgtagctcccataattcccatatgtcaggggagggacctggtgggaggtaattgaatcacaggggcgggtcttccccatgctgttctcttgatagtgaataagtcccatgagagtggatggttttacaaaggagagttcccctgcacatgtggtcttgcctgccgccatgtaagaagtgcctttgctcctccttcaccttccaccatgattatgaggcctccacagccatgtggaaggaactgtgagtcaaagcttctcaccataccagttttgggtacatcttttttagcagcatgaggacagactactacaattgctaatatt
